United States Patent 10,233,495 (METHODS AND COMPOSITIONS FOR SCREENING AND TREATING DEVELOPMENTAL DISORDERS) - sequence listing, part 27

SEQ ID NO: 260 - DNA, 2762447 bp, Homo sapiens (residues 1-1,381,224 of 2,762,447)
  misc_feature (526527)..(526527): n is a, c, g, or t
  misc_feature (526547)..(526547): n is a, c, g, or t
  misc_feature (526549)..(526551): n is a, c, g, or t
  misc_feature (526553)..(526554): n is a, c, g, or t
  misc_feature (526556)..(526556): n is a, c, g, or t
  misc_feature (526651)..(526651): n is a, c, g, or t
  misc_feature (526655)..(526655): n is a, c, g, or t
  misc_feature (526661)..(526661): n is a, c, g, or t
  misc_feature (526671)..(526671): n is a, c, g, or t
  misc_feature (526698)..(526698): n is a, c, g, or t
  misc_feature (526702)..(526702): n is a, c, g, or t
  misc_feature (527906)..(527906): n is a, c, g, or t
  misc_feature (542313)..(542313): n is a, c, g, or t
  misc_feature (549022)..(549022): n is a, c, g, or t
  misc_feature (549028)..(549028): n is a, c, g, or t
  misc_feature (553784)..(553784): n is a, c, g, or t
  misc_feature (553788)..(553788): n is a, c, g, or t
  misc_feature (553836)..(553836): n is a, c, g, or t
  misc_feature (1857819)..(1907818): n is a, c, g, or t
cacttatttcattttcatggcactggccaatttctcctttgtttggcaaaaatgtttttccctcctacctccacttccctcatactgctcccttaataggagccccctcctgttttgttcctccagtcagtaggtgccctttgagatcctgccaagtggaccacaccaggccaggcattaagggggatatgaggagaaccagaagaaaagctgaaaccctcagctgcaaagtgtggggaggctgtaactgatacagtttgggactgtgtccctgcccaaaaatctcctgttcaattgtaatccccagtgttggaggtaaagcctggtggaaggacattggatcatgggggagggtttctcgtgaatggtttggcaccatcccccgtggtgctgtctttgtgacagtgagctctcatgagatctggttgtttaaaagtgtggagccaggctgggtgtggtaactcacgcccataatcccagcactttgggaggctgaggtgggtggatcacctgaggtcaggagtttgagaccagcctggccaacatggtaaaaccctgtctctactaaaaacataaaaaaattagctgggcgtggtggcgcagcctgtagtcccagctacttaggaggctgaggcaggagaatcgcttgaacccgggaggcggagattgcggtgaactgagatcgcgcccctgcactccagctccccacttggtctcttgcacctgctcctcccaggtaagacacctgctcctcccaggtaagacacctgctcctgcttggccttccgccatgattgggagcttcctgcggcctccctagaagcagatgctgccatgcttccggttggcctgcagaaccatgggccaatcaaacttcttttcttataaattacccagtctcagctattgtctcacagcagtgtgagaacagatgaatatagtattctaggtgggaaataccaacgctgctttttccctgttctcttgggtgggacaggaggacgccctgcactgcttcttccagcccagggagttatcaagcaaaagcaagtgcttctgtgagaactgtgggaagaagacccgtgggaaacaggtactcattccctaaatcagactcagctgtccctcggtgcatatgggggatttgttccaggacccctgcttttaccaaaatccacacacactcaagtcacacccagtcggccctgtggaacccacgtataggaaaagtcagtccctcatctatgcggttgtgcatctgggatactttatttttgatgagcatttggttgcagatgtggaactcgtgcctatgggggagggcagactgtatttatttacaacaatttgtgtataagcggacccatacagtccaaacccgtgctgttcaggggtcatctgtccttcactagtctggggttgccccccgtggatttcctgatagaatcatcagaggccccgaggacaccccatggtgggtgagaaagggaatctgggtctggctagtatctgggacgctgtggttctgatatctggagccgtggatgtggcttctcatgtcgcatcactgagagggactgcaggagggcgcctgagagcagccggcagggcgtttccctccaggcgagaccagctccctggagcagacgcggtggctccctgggtcctggtacctgtgcagagccctgtgcccttgtgcctcttgtggggggccacatggtggtagaatagccaagttttgcattattctcagaggagctcagcagattcggcgaacaggagccttgaactccgtgatgtcgccccgctcccctctttttgggaagaacgcgttgctagccctgacatttctctgactctctcattccaagtagacttcatctccagagtgattttgatttttcaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcaggtgggatgatcccgacctccttgccatcctgcctctccccagatgccatgtcctttctgttttcccttccttcacccccagtctgctaggagccacctgttcctcagagactgtccccagcctcaaaagcctttcttctttctaaatattggatttgtgttcatatgcctcacagcactgagggacagaatccagaattcagtaggcttctttggaaataatgtggaatacatagaaatgcataggcaaacatgtcattgtgggttcatagtaccaaccaaactttcttcctcagatggcctgtgcccactttgaggataatcataaagtagccagttgactggaccacatttaatcagagtaaagtttaattcacttgtcctgagataataacttatcaagagattctgagaaaaaaagagacacaaggccaggtgatgtggctcatgcctgtgatcccacacctcaaaaggctgaggcaggaggattgcttgagcccaggagttcgagaccagcttcagcaacataatgagacccccgtctctcaaaaaaaaaaaaaaaaattagctgggtgtggtagcacaaacctttagtcccagctacttgggaggctgagttggaggatcacttgagcccaggagtttgaggctgcagtgagctatgatctatcattgtactccagcctgggcaacagcgcaagaccccgtctctaaaaacaaaacaagaaaaactaaaaaaaaaagacacaaatatctttttttccatagatttgaaatgctacataacaaattttgtattcctgtatgtacgggtctatttttggagtgtctcttctgttttattggtctgtttggctatttatgctctagaaccatgacatttagaaaattaagacctgataatatgttacaatagctcctattataacatgatttctttacctacttaggccgtatacatttcataggattctctttttctttccttctagttctttttatttctacctgcagattctgcccaatgaagtgtatttaaaattgtttttcacttaaaaaagacttttttgactggatgcagtgggtcacgcctgtaatctcagctctttgggaggccaagaggattgctggagtccaggagtcgagcccagctggacaacaaagcaagactccatctttgcaacaacaacaaaaaagactttgttatggaacattacaaatagataccaaagtgtgtagtgaaggaagagttagacagtgaatccttggctgtaacagttaccaaaactcatggcaggtcttgcttttcctataacccaccctcttgtttcacccaaccctgtactggatttttttgaagcaaatcccagacatcatactatttcatttataaacacttcattatgtatccctaaagaataagcactcaaaagataatcatctccatcttgcaattccttaatagcatcaaatatctggtcaacgttcagacttcctgactgttgtgtaatctatgtggtttgtttgactctagatccaaacaacgcctacacttgcatttggttaagtttctttcttttcttgagttccttttagatttccgctccttttcttttccttgcagttgatttggttgaatatttttttcatatgccagcactggctggttgatatcttttaacatgttcctgtaacccttttatttcttgtaaactaatatttagatacagatattgccctgcattttgtaaagttctgcacaaagtctgcaaatggaaatagggataatttcagcctccactgtgggtgactcagctttgcgtctgccgcccttgccctctgtctcccctccccctacaaaagacttttttggctgggtacggtggctcaggttagggtcattcctgggcttgtggagaaacagaactgtgttctgatgatccccacccctcccaggggaaagttctaatcttgccttggctttgggggcctctctcatgacctgccttccatctcttgcgtgctctgccctgccaagctgctgagccttcgcagttcaggatccacactcgggaaagcccctcctggagggtgcccactggctgtgggtcgggactgttttctaatattctaaagtcccagagtcgggcctagtgtgggcaggtataaatgtgtgaggcagtcgtgtttgtggtggtgggtgaactgtctcgtgcctgtctctttccagtctggagggcagtatgagctttttgctgtgattgcgcacgtgggaatggcagactccggtcattactgtgtctacatccggaatgctgtggatggaaaatggttctgcttcaatgactccaatatttgcttggtaagaaacatcatccacaattgcctcctgccctggattggccacctctagcaaatgctgggctcagggctgcgtgggtctctgagatcaagacacactgtgatcctgctgtctgggtgtggggcctttgatgagggttcaagcctttttcggtctgaagtccccatgtggtttgcacctctgtaagggttcaattcacttcacttctaagtttttggtgctctaggctcatgctctgcagcttcctgctttgtgggaaatgtctagagagcaacgagtgttagaaatatgtaagttaggcctctgggataagcatgaccaagtttaaacacagggacaagggcactaaacatacttcattgcacaagacatcctgctgctgttgctccaggctcttgggagttgctaggggtgggcttgtctggaggatgaggggcacattatagcatcctgtcctctgtgggtgcttgtgtcagctggctgcttgaccccatttgtttctggcttccaggtgtcctgggaagacatccagtgtacctacggaaatcctaactaccactggtaagaaacagatttgggtaattggagtctgatgagctcacatagggtccttggagctgcatgaaacgcccatggattcccctgttactaacatgctgatggctcactgtccgcctcatctccagcactcaccccaccaccccatgtttgcctcacacgtcacactccaggaatattaaagtacaggtagctgccaatcagccgtgccctccatctcccgtctgctgtgcacatgcacttcctggccgtattgtcctctcctcgtttaccatctaggccaactccccactcatgttttcatactcatggccttttcctatcctgtgaagcctttgctgattcacccagattcgtaggggcttcttgtatggttttcttttcttttcttttctttttttttttttgacggagtctcgctctgttgccgggctggagtgtagtggcacaatcttggctactacacttggctcctcctcccaggttcaagcgattctcctgcctcagcctcctgagtagctgggactacaggtgtgtgccaccacgcccagctgattgttttttgtatttttagtagagacggtgtttcaccatgttggccaggatggtctcagtctcttgacctcatgatccacctgcctcagcctcccaaagtgctgggattacaggcatgagccaccacacctggccttcttatatgcttttattgcatttgagcatacctcttttacagcgaagatcttttttttaatttaattttatttttagagatggagtcttgctttgttgcccaggctggagcactgtggtgtgatcatagctcactgcagccttgaactcctgggcacaggtgatcctcccacctcagcctcctgaatagctgggactacaggcatacagtctgtacaccatgcttggcatattttaaaaaaatgtttgtagagatgaggtctcgctatgttgccaggcttgtctcaaactgctgggctcaagccatccatccatttcagcctgccaaagtgcttggattataggcatgaacactgcgcctggccatcacactgtttttttgtttgtttgtttgtttgttttgagatggagtcttgctctgtcacccaggctggagtgcagtagcaggatctcagctcattgcaagctctgcctcgtgggttcatgccattctcctgcctcagcctcctgagtagctgggattacaggcgcccgccaccacgcctggctaattttttgtatttttagtagagatggggtttcaccgtgttagccaggatggtctcgatctcctgacctcgtgatccgcccacctcggcctctcaaagtgctgggattacaggcatgagccaataaatatttttataatcattaactaccgaggagaagctggagagaaaaaaggtggatgaagttaaggcagagagactttgtaagtttcttagctgagcttttggagactgtatatcagagatcctatttgaggtgattttcagctacagagataggcctggtcatttgaaaaataatggattaggtgaagcttgcgtttgaaatcctccttctacttttcatctttctctcttgtttattctgaacatccatcttagacacccaatctttgtcactttgtggttgtcattgatttccctgttattgagatcagaggttggcagactttctctgtaaagggctggagagaaagtacttcagactttgtggtctgtgcggtgtctgttgcaaccacttaactctgccctgtagagcaaaagcagccgtagacagtacatgggcagatgagcatggctggggtccagttacatttacttgcaaaaagagggttggagactgggtgcgatctcccacctttaatcccggcaatttgggaggccgaggcaggaggatcacttcaagccaggagttcaagaccagcctgggcaacaaagcaagactccatctctacaaaaaaataaaaattattatagctaggcatggtggtacacatccatagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcacgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacatagtgcttatcttcccaggccacctattttgttcctctccaaggtgatggatagatgaaggcctaatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggattgtgctatagaaattcaaaggcaagggaagtcacttctgttgtggggccctgggaggagcctccaggctggaaagggttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaagacttggaagtttgcacctgatctggtgggtggtgaggggcccttgaaggggcaaggaggcgaggagcactcagctgtgttcttacactgatctgccactggggttagagacaaacgtggtgggaatggaaagccacgcacagtcactagcgcctctagggggagaatggatgtggctggtgagagaacaggggggcccagggagagtccggcaccaacctgggtgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctaattttgtttgttttgtcttggagaggaggtcaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagtgggcactcagttccactaacgaatgatgcccgtgtggacagacagaatgatggacaggcagatgaatgcgtgggctttatgtgaaaaaggtcctcttggttgttgacaagatactgttttaaagttccattttgccatacttcgaacagcttgtcattagctcaatttagccacatgtgaaatcactaaggcggacggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctgttctatcaaaacaccgctacatagaaaatccccatgcacatatttctcctaattgtggaaatattttacataaaagactcttgacatgggatgaaattcccaggttattggaattttaatatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcattttaccaaataaaatagctccttgatgtcatatgaatccacgctatgcttaatgagtattggttagtaaaatgcctataactagtaatcttcatctatgcaattaaatattcattcataaaacacttcaaatgtaaacaataattagtaaaagaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaaataaataaaagcctttaacccagaatgctgagtaaattggccaaaaatgctaacctatgcatttcaatattataggagttgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttcttcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcaaaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaacggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacttccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtccttgttagcatgccttgtgggtgtcattagcgatgtcatatagagcatcctcattggtgatgtcttatatggtgtcctcattagcgatgttgtgtacagcgtcctcgttagcaatgccttgtacagtgtcctcgttagcaatgtcatatacagtgtcctcattagcgatggcttgtacactgtcctcattagcgatgttgtgtacagcatccttgttagcgtgccttgtacggtgtcattagcgatgtcgtatacagcgtcataattagcgatgtcttataaggtgtcatcattagtgatgttgtgtacagcgtcatcgttagcgatgccttgtatggtgtcctcattagcgatgtcgtatacagcgtgctcactagcgatgtcttttttttatatatatactttaagttttagggtacatgtgcacattgtgcaggttagttacatatgtatacatgtgccacgctggtgcgctgcacccactaactcatcatctagcattaggtatatctcccgatgctatccctcccccctccccccaccccacaacagtccccagaatgtgatattccccttcctgtgtccatgtgatctcattgttcaattcccacctatgagtgagaatatgcggtgtttggttttttgttcttgcgatagttactagcgatgtcttatacgctgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgccgtgcacggcatcctcgttagcaatgccgtgggcagcgtcctcgttggcgatgccatgggtggcgtcctcgttggcgatgccgtggacggcgtcctcgttggcgatgccctgggcggcgtcctccttggcgatcccgtgggcggcgtcctccttggcgatgccctgggcggcgtcctcgttggcgatgccctgggcggcgtcctcgttggcgatgccctgggcggcgacctcgttggcgatgccctgggcggcatcctcgctggcgattccgtgggcggcgtcctcgttggcgatgccctgggcggcgtcctcgttggcgatgcccttgtcggcggcctcgttagcgatgccgtggacagtatcctcgttagcgatgtcgtgtgtggcgtcctggttagtgatgtcatgtacggtgtcctcatggggagctagaaaaacacagagttaaggtcagtgccctggtggtggagactgtgaatcacccaggggcttgcttggtgtgatgcatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgtgaaatctaacttagctgccagcataaagattctatctcatttacttggtctcgagaaaatctagcacatagtaagtagaccaaaatgtttattaaatgaaaacacagagcagagataggggggctgctaggcagactgggttgcacctgattacctggatgataataaactgcacaaaacctcggtcaaattaatattgaaactgccttttgcttgggctcatttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacagagttccctcatgtcttctacccaggttgaagtccagcaaaattgcgactgtcctctttacaacttgcgagaccacactgcttctgcatttgcctgttgtatgtatgagatttacacttgttttagagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaagtacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaagggatctgtgagctgagccaaacacctggggatctttgtgcttttgacacactgatgactatgccggtccgtggggagatgagcctataactgccctgggttgtgtgaccacggaggccactttatgatgatgggcagtgtctggggcctcttgggctcgttgctttagggcttatacatgaatgctggactccctgtgtggtggtgaacaccccatgactaagtgcatgtcagcgtcagcactggcccacactcctgggttcgtgttttcactgtttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggaggctcttcacattgaaaccaggcaaggatgccacacctttcttggcatccagattgttttcttggcaagtgattccagaatacttactagattcaagcctcagaggggccacctgcaccacctgcaatacagaaacaaagctttttgaggggtatgtcatgttgtggattgtttgcacaaggctctgtttctctcaatgaatactgaaaacttgatcagaaagtgtagtcaacttcaaggcctccaaaacaagagtaggatacacactggaaaagacatcagcttctggatggtggatctctcaggtccacgtaggttggcaagtgcaaaatactgaatccaaggagaagacattgcttccaaggacaaggaccccaaggatacagtctacaacctgaagccgtcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcgagaaatagagtccctggcattttgctgatggcaacttaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaataaaagcaaagtttaatagatagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacatgggttgaatgctggtgtgttttaactctgcagtgcaaacagctgcaacaagtgtggtgaactaaacaccagatggccctttgctgccttatttgtcattgtgccttacatgtagcttgcaggatttgattacgcttatgttttgtggtgatcatactttcaactattcctaaaatactgcttcagtcttatctgtttggggtcaactgccgaggatttcatacaaattaatgaagtttgtgaatctaaagttctacacaaaggtggaaatatttgcaaatcatttatcttgtaagagactaaaatttagaatatattttaaatatatttaagatatattcaaaaatctacagcaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctattcttaggcaccccaaagaatagagaacagaaatcaaacagatgtttgtatactaatgtttgcagcatcacttttcacaggagccaaaaggtggaaataatccaaccatcagtgaacaaatgaatgtaacaaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatattgcttattgtggacaaggttttgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccagatgccagtcttgttagctgccttcctttaccttcaagagtgggctgaagcttgtccaatctttcaagattgctgaagactgtatgatggaagtcatctgcattgggaaagaaattaatggagagaggagaaaatttgagaatccacagtactcaccctgcagggccaagaactctgtctcccatgctttgctgtcctgtctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccaaggcacctcgctcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttactttcatcatttcttacatattggggcctaccatacattgtacggtgaaattagtgctatgcatcatggtagaaatataaattggcaaaagtaatttagaaaatagttcccttctttcttaaaaaaattaggctgggtgtggtggctcatgcctataatcccagcactttgggaggcagagatgggtggatcacctgaggctaggagtttgagactagcctgaccaacacagcaaaatcctgtctctcctgaaaatacaaaaattatccaggcatggtggcgtgtgccagttgtcccagctactcgggaggttgaggcacgagaattgcttaaacctgggaggtggaggttccagtgagccgagattgtgccactgcactccagcctgggtctcagaaaaaaaaaaatttttttgaccaaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatcgtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagcattaattcaaatggttgtcacaggtcacttaaagttagatagttgtcctacaaatatagggtgaatgttattcatgaatttcctgaatctattgcaataatcacatttttttccattaaactcttgaggtagctaattttatttattgcattttcaatgttaatctactatttcatatattgagattaactcacattagtcagaatttacagtattttaaaatatcacagaatttaatttaccttatctggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagcctcctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttatattctctatcagagaagatgctggttaatgcatttacaatagatagggctgttgacatcttgctgacagaggaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggagaatacagcaggatgactgtgagtgcagggctggtgcagagtaggggcccggattcaaattccactaagccatgtggacctggcaagctcatgtcctccctctgccctcagttctctgcactgtcataatgtaattttagcaatactttttaggccctatttaggccctacttcttagtatcacagtacagggctaaaaaatcactaaatacaggaaaaccttagagaggactggtacttcagtaatgttctctaagtgtttactacaggccaggaggaataagctggacactcagcagtggcggaatatggagggggaacttggatggctccggggcagtggagcatgctttcctgttcggcttttccgtgggcatgatgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccagagacccaagagacccctcactgtttttctccagtcctcctagcccaaggtgtgtgggtggacaaaggtgatgctctggaggaaatgcctgagataaggacaggtccttaatgataaagaattctccttcctctttcagatccttgacctcccagtatgacagcttaaaggctgtcatctctgtggcctgcctcccctttcccttcaccctgccagctgcctctcagtgactgtctcctccagtgactacactgagggaccagggactgcttgcctcccgaggctgctcagaccttccgacactgcaaaatgattgtcaaaagatgggtctgcaaagagtaacttcccttccactgatcaaacctgaatatgcaagctactgtgaattaactggaaaagtggccgtgtgggctggtgctttggtgatttaatgaattaagtctgcaacccccactgcctccttgactattgatcagagctgcctgcaataaggtctggctaagaatgggcagtggctgcaccagctctgggtaaaatttgacctaaaatgaccagtctcattcactaacctcaccatagtcttatgggttcaatggacctgtccaatcctttgctctgttctctccatcaccttcctgtgtaattttcctccaccacgcacataagagaaacatggcacaggggagctaatcgcctcttttatcccccacttcaggctcacacgtaagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagtggttgtagttcaggccttcaacattagcaccgtatgaggaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaacatggcactgagagttgtgctgggtaaacacaacatttttttcctaggggaaacacacatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccagacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagactggaaataaggttcaagtcaaaagccccaactctagagtagagttgccttaggaaagcacaggagcttttgttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagacttcgccatattctccccaggggaataacttaatctgtggggtgggggatggaacgttgaaggatgcaggttgaaggatgcaggatgtaaaaggaaattatatatatattatgacatatattatattatatatattatgacatatattatattatgacatatattatatatgacatatatataatatatgataattatattatgtatataatatatattatttatatatattatatatattatatatatgatatataattatttattatatattatatattatataatatataatatataattatatatcatatatattatatatataatatatattatttattatatattatataatatataatatatataatatataattatatattatatattatatattatatattatatataatatataaataatatatattatatacataatatataatatataatatatataatatatataatatataatattatacatattatatataatatatattatatatactatatatattatatataatatatattatatatcctatatatattatatatagtatatatattttatatataatataaaatatatataatatattacatataatgtatatattatatataatatatatgttatatatattatatattatataaaatatatataatatattatatattatatatattatatatatatatataaaatttgggaatttgggaataaacggactcccaattcacactgggactacaccagctgccaccatgcctggctaattgattgtatttgtagtagagacagggtttcactgtattcgccaggatggtcttgatctcctcaccttgtgatcctcttgccttggcctcccaaagtgctgggattacaggcctgagtcaagatacatattttttaaatgaagaaaaatttcaaagatactctgcttggtacagtaatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacgtaggaccaagggcaggagatccctaatcccatcaccatggtgatagggcataaacattccagggtgaaggcacaatccacactgtgaggtccaactgctgccatgcagacaggtgggcttttacaactacaggaaggtcatcaaaggctcagtgttttgtttcaaaaactgaatcccaagcccacacattattatgctggcttcttaaaataagttatgagatgggaaatagggcacccaaaaatatatatatatataattatatataatataatatatagtatatatataatatatttaatatattttttatatatatatatataaaatttgggaatttgggaataaactgaatcccaattcacactgggactacaccagctgccaccatgcctggctaattttttctatttgtagtagagacagggtttcactgtattggccaggatggtcttgatctcctcaccttgtgatcctcttgccttgggctcccaaagtgctgggattacaggcctgagtcaagacacatattttttaaatgaagaaaaatttcaaagatactctgcttggtacaataatcaaatatataaattgaggaataaaacataatcatgaaacatatttataactgcatatggaaaatacagaggctaattttttaaataatatattttgaaagtattaactagtaatttgaaaagatcgcatttgacaggccagtaagaacataccttgaatgcagccacacaggttccccataagaaaaatcaaaatcagggaaaatgaaaccacaatggttcaatctgctctgacgtttgaaaaactcagcacagatagtggcacttaggaccaagggcaggagatccctaatcccatcaccatggcgatagggcataaacattccagggtgaaggcacaatccacactgtgaggtccaactgctgccatgcagacaggtgagggcttttacaactacaggaaggtcatcaaaggctcagtgttttgtttcaaaaactgaatcccaagcccacacattattatgctggcttcttaaaataagttatgagatgggaaatagggcacccaaaaaaatatatatatataattatatatgacataatatatataatatatataacatatatataatttccttttacatcctgcatccttatattatatataatattatgtataatataataggtattattatatataatataatatatatgaatatatatagcaatataatataatatatgtaattatatataatgatatataatatataattatctatattatatataatataatatatataatataatataatatataatatattatattatatagtaatatatattataatatattctatattgtattatataataatataatataatatatattatatataatatatattatatataatataatataatatataatataatatataatataatataatatataatataatataatatataatataatatataacataatatataatataatatataaaataataattaatatttaaattaattattattaattaatattaactaatattaaaaataatataaaatacaattaatatatctaatataacctataattattatatataatataatatacaattatacataatatatataataaaatatatataattatgtgtatttattacatataatataatacataaattatatataattattacatataatataatatatacttatatataattattacatataatataatatataattatatataattattacctataatataatatatataattatataattatatataattatatatacaagataataatacataatatatataatatattatacaatataatatattgtataatatattatataagatattatatataatatgttgtataaaatatatatattatatataatataatattatgtataatataatatataatatatattatattataacatattatacaataatatattataatataatgtatattataatctaatatattatatattataatctaatattatatattataatctaatataatattatatattataatctaatataatattatattatatataacattatatagtattatatattttataataatataatatataatatattatgatatattatatataatattatataatatattatgacatattatatataatatataaaatgatatattatatatattacataatatattatgatatatattatatattatataatatattatgatatatataatataatataatataattatatgtaatataacattatatatcatatattatatattatatatcatatattatatatcatatattatatattatataccatatattatatattatatatcatatattacatataatatatgtcacatattgtatgtaatatatgtcacatattatatgtaatatatatcatatattatatgtaatatatatcatatattatatgtaatatatatcatatattatatgtaatatatatcatatattatatgtaatatatatcatatattatatgtaatatatatcatatattatatatgtcttttattatgtaatatgtatcatagatattacataacgtgacatataatatatattatttatatataatgtatattatattttatatatattatatatattatatattatatgttttatgtaatatatagtacatataatatacattatatatatataattttttttagacagattcttgttctgttgcacaggctggaatgcaatggtgccatcttggctcactgcaacctctgcctcacgggtggaagcgattgtcctgcttcagcctcccaggtagctggggctacaccacactgggactacaccagctgccaccatgcctggctaattttttgtatttttagtagagatagggtttcgccacattggccaggatggtcttcatctcctcaccttgtgatcctcttgccttggcctcccaaagtgctgggattacaggcttgagccaagatacatattttttaaatgaagaaaaatttcaaaggtactctgcttggtacaataatcaaatatataaattgaggaataaaacctaaccatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaaaggttcaatctgctctgacctttgaaaaactcagcacagatagtggcacttaggaccaagggcagcagatccctaatcccatcaccatggcgatagggcataaacattccagggtgaaggcacaatccacactgtgaggtccaactgctgccatgcagacaggtgtgctttcacatgtacaggaaggtcatcgaaggctcagtgtttcatttcaaaaactgaatcccaagtccacacattattatgctgtgcttcttaaaataagttatgagataggaaatagggcacccccaaatatatatatatattatgtataatataatatatataatatataacatatatataatttccttttacatcctgcatccttatatataatatcatatttaatataatatataatattatgtataatatatattgttatacataacattatatataatataatatatataattatgtataattatataattatatatgaaatataataatgtataattatatatgtaatataataaagtataatagataatatatattatatattatacaaaatattatataatgtaacatgtaatatatagtatatcataatataatatattttataatataatatattatatattatatatgattacattatatgatattatattatatattatataaataattatatataatataatatataatatataatataatataattatatataatataatatatataatataatataatataatataattatatatcatataatataaaatatataatatataatataatataatataattatatataatatatcagatataatatataatatatatcagataaaatatataatatataatatatatcagatataatatataatatatatcatatattttacataatatatatcatttattatgtaatatatatcttttattatatataatatatatcatttattatataatatatgatatatcatatatgatatatatcatctatatcatatattatttatcatctatatcaggtatgatatatcatctatgtcatatatacgatatatcatctatatcatatatgcgatatatcgtatatatcatatatgatataccatgtatatcatatatatgatatatcatgtatatcatatgtagtatataatctatatcatatatattgtatataatctatatcatatatattgtatataatctatatcatatatattgtatataatctatatcatatatattgtatataatctatcatatatgttgtatataatctgtatcatatatattgtatataatctgtatcatatatattgtatttaatctgtatcatatatattgtatataatctctatcatatatattgtatataatctatatcatatagtatataatatatatcatatattgtatataatatatatcatacatattgtatataatatatatcatacttattgtatgtaatatatatcatacatattgtgtataatatatatcatacatattatgtatgatatatatcgtatatattatatatgatatatatcatatgtaatatatacgatatatatcatatatattatatatgatatatatcatattaagttaagtttggggatagcccagaattatatatggattttcaactgcacaggagctggtcccctaacccttgcactgttcaaggatcaacagtatgtataatactacagattttattcatattttagagtgtagtactactactcattaaaaaaaattaactatgaaacagcttcaggaaggtcttccacgagttcttccagaagaaagccttgttatcatagagaatgacagctgcatgtatgttattgccactgaagaccctgaagacctttcacttggacaagatttcgagatggaagacagtgatattgattatcctgacccttacaggactaagctagtgtgtgtgtttgtatcttagtttttaacaaaaatgtttaaaacataaaaaatcaaaataaatgaagcttatcaaataaggatataaagtatttctgtacagctgttcaatgtgtttttgttttaagatgtgttattatcaaagaatcaaaaaattaaaaaaattaaaagtttataaagttatgataagctaagatgaacttgttaaagaaagaaaaaatttaaatacatttagtgtagcctaagtgtacagtgcatataaagtctatagttatgtacagtaatatcctaggccttcgcattcactcaccaggtactcactgactcatcagagcatctgccagtcctgcaacctctgttcatgctaaatgtcctttactggtgtaccactctctttaaattttgtaatatatatatatttttttctttgttttttttgagaaggagttttattttgttgcccaggctggagttcaatgatacgatcttggctcactgcaacctctgcctccggggttcaagtgattctcctgcctcagcctcacgagtagcagggattacagccccacgccagcacgcccagctaattttgtatttttagtacagacggagtttctccatgttggtcaggctggtctcgaacttctaacctcaggtgatccgcccccctcggtctcccaatgtactgtgtttttactgtatcttttccatgtttagatattactactgtgatataactgcctacagcagtgggccccaaagttttgacaccagggactggttttgtgaaagataatttttccacggagtggggatggctttgggctgaaactcttccacctcagatcatcaggcattagttagattctttttttctttttttttcttttttagactgagtctcccactgttgccaggctggagtgcagtggcacaatctcggctcactgcaacctctgcctcccgggttcaagtgattctcctgtctcagtcccccgagtagctgggactacaggcatgcgccaccacacccagctaatttttgtatttttagtagagacggggtttccatgttggccaggattgtcttgaccttgtgatccacctgcctcgacctcccagagtgttgggattacaggcgtgagccacagcacccagcctagttagattctcataaggagaacataacctagatcccttctatgggcagttcacaatagggtttgtgctcctgtgaaggtctaatgctgctgctgatctgacaggaggcggagctcaggcagtaatgttcggctggccagccactcatctcctgctttgtgcccaattcctaacaggacacgaaccggtgctggtccatggcttgggtgttggggaccattggcctactgtattcagcacagtgacatgctgcacaggtgtgtagcccaggagcaataggctgtacgatatagcctaggtatgtagtaggctacgctgtctaggtttgtataaagtacactctttggtgtctgcacagccacagaatcacctaatgatgcatttcttggaatatattaccattaaatgagatttacctgtattagtgtcatctcaggtttattgtctagtaattttaaaagtatttgtatattctttcccagacacatcatcatactctggtgcatatctctattttattccctagacccactcttaatttttctgcattctgctttgttccttaggaggctcacctgaattggatacttcagagatctcccttaccctcatgcttttattggggttcagctaatggagggggtggcagaagataggtgagagaagagtgtgtttatcccccacctctgcccctgcagggtcagcacaggcagactgtgtccctttgctgaagatcacagcttctgtctggtgccttcttggcaagctggcactgtctctagtcaggtgactgcttggccccttactacttacactcttctgtctggtttctttgtgactttcctgctgtgctgtaagtagtccctttattagaatccatccacattacccagttatataaagacaaatagttggtcactgatgtagttcactccctgagaatcagccttcatcaaagatccctaacagtcacatattctgttggccgctccattcctgctccccattattctagttgtgtcttccttgtctctagtgcagtcacaaagcataagcgcctccactgtcacttgttctttgcaactctaggatcacatcattccccttgaaatcagagaatctgcaatctccccaagcccacaaaattcagccatcacagtacttttcaagcatgccagcagccctccccaacaaacgaatccttaatttcttagagaaacatcttctgggcttcctgtgggacacagtgcgggtcggcttggcatgtggatcacacctgatatttttacccccacctcctactattcctattcctttgtatgcacctctctttattatgctaggaaagctctggcaacacaacctcaaaataagcaggccagtgtggattcacagtttctgtcagacaaacaaacttgagcaccccttctaacttcttgggctaagactttaacttcagaatctctatgtatctatgttgataaacttagcctatgtcaagattatattctgcatgccttagtcaaacaccatgtaaatctatacctcatatattctctaggctttagctgatagggattagcaaagtagtgtggttgttttggtctttaaacaatgtccattttctaccagctttccattgcactctttttttttttttttttttttttgagatggagtcttgctctgtcgcccaggctggagtgcagtggcgcgatctcggctcactgcaagctctgcctcccgggttcacgccattctcctgcctcagcctcccgagtagctgggactacaggcgtgtgccgccacacatggctaattttttgtatttttagtagagatggggtctcactgtgttagccaagatggtctcgatctcctgacctcgtgatcggcccaccttggcctcccaaagtattgggattacaggcgtgagccaccacaccgggccgaatccattgcactcttacagaccatgttgacaaaattataactgcaacagtcaactacaatagcaattttacctctcatgtaccactttaaaaaacacatcattcccaataaccacatttgatgatttaagtaatcatgataccaccgtacactacagatgatcaggtttctgtctcctcccgacaacaaggtcaggaattcattcagactgaaacaggtcagcaaaccacttccagattctcatctataaagatctatttctagaaccatttctagtacctatacaatattagaatcaagtcaggaagcagaaaacattctagatattttaaacagaaaacaattcatggagagatcaattacaagagtatgtgtagcaaaagatgaaagggtcaggtaacttgataaatctctgcttcttttgtgttgggtgataaaaatgttgaccagagatcagtggcagatgatccaaggcgtcagctgtccaagctcagcatctggagccggtgctgaggaaatgtgcatttctaggtctgggcgccattggaccatcactactgtccttgaagctgccaccgtgagaactcacatctcagctgctatagccacagctgatattgtcattgcttccagaattatttcccttgctccatcgtggggatcccgcaatactgctgctgctgaaatcactgttgttgctccttccagaactgtcggcaccgcagcattattatcactgcagctaccactggagatggctacagacaccagaaacggaagagcacctctcccctcctccggcagtgtgactttcagtcggctcctctcgtagccagatggtatagaaatgacacaccaatgtccttcagaacatacatgcaaaatagtttaaatatactagaaattctattccccttagaaaactaagtccacctacatatttttcaaaaatccatcagcaatacagaataaaggcattggttctatacagcgttgcaagaatattttaacaatagaaggtattttaatgtcattcaccacattaggagattgaaaaagggaaaacacaggattaccttagcagatgtaggaaaaaaaataagatggtaaaatacaacattcatttatattaaaatctttataccaaactaggaaaagcagacaaatttcttaacctgataagcttatctataacaaaaccatcgacaccaccatatgtaatgttgaagcataatcgttattttttataaaagctaggaaagggaatgagatgtctgttgacactgctcgtatttatcattgtcctggggtttctggccagttcagttaagataggacaaagaaatattatagaaagaggaagaaaaaaagaaaacacatacgttgtcattgtgtggagtttctgtttgtttgtttatgtgtttttgtgagatggtgtctcactctgtcgcccaggctggagtacagtggtgtgatcttggctcactgcaacctcattgtgtggagatttgtaattacccatagaaaatccaagaaaatttgtggatgcactaatcaaatcagcaaggttttcagatatgaaggcaaagtaaagagaaaatgaaattcttataaacagtagcaaccaattaaaaatattatattataatatcacattcatggtaacataaaacattaacgtatctaagaattaattcagaaaacacatgatctttcatttaattttattaaagttatttcaataaatataccaccagtatttttttagaacttgattggaaaagtcatattaaaataatcaatggaaaggaagaaccaaagttattctgaacaataatagcctatcaatatttaaatgtgttttaattataataattaaaatggtttgctttggctcagtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatataaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattcatgatataaaataaataatatagtagaaaaaatgattaagaactactacacaatattcacaacagatgataaatagtgaattattgtgaaaagacaattgaaaagagcaaggtacaattcaacagcaataagactttatgcccttttctataaaaacacaaaactatgccaagggctttaggaaccgtgaatttatacacggcgaaggggagtttaaatctgccactttgaagagttttttggaaatatatagtaaagttgaaaatatatacatatgtgtatatatatatacccacacacatacacatacacactagaaattccacagggtaaaccttctccaagagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattgtctgaatttatatggatcaatttttatatattgaaacatcgttgcattccaggaataaatcccacttggtcatggtgtataatccttttaatatgatgctgaattcagtatgatagtttttttttagacaaagttttgctcttgttgcctaggctgaagtacaatggcatgatctcggctcaccacaacctccacctcccgggttgaagcgattctcttgtctcagcctcccgagtagctgaggttacaggcatgcaccaccacacatggctaattttgtatttttagtagagacaagagtttctctatgttggtcaggctggtcttgaactcctgacctcaggtgatccacccacctcagcctcccaaagtgctgggattacaggcatgagccaccgtgccccacccagtatactagcatttttagagtttttgcatcaatgatcagaggcatattgatctgttgttttattttcttacagtgtttttggctttggtatcagggtaatgctggcctcatagaaagagttaagaggtattcactcctcttccactctttggaaatgcttgaaaagaatcagtgttagttcttctttaaacgtttggcagaactcaccagtaaagctatcaggtccaggacttttctttgtcatgagattgtcttattactgactcaattcccttactaggttaggtctattctgactttctgtttctttataattgagtcttggtaggttttgtgtgtctaggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaaaaagagctggcatagtggcgagcccaggaattcaaggctgcagtgagccgattgtgccactgattctggttgcatctgattgttgccagggcaatagagctagaccttgtctctaaaacatagacaggcagacagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctgggttcaagaaattttcatgcctcagcctcctgggtagctgggactacaggcacgtaccaccactcccagctaatttttgtgtttttagtagagacagggtttcaccatgttggcctggctgatcttgaactcctgacctctagctatccacctccctcagtctcccaaagtgctgggattacaggtgtgagccaccacaactggccacagcccataagtttggatatagtgtgctttcattttcatttgtctttaagaattttataatttctttgtgatttctttgatccattggttgtttgagagtgtgttgtttaaattctactaatttgtgaacttttttaaatcttctgttattgatttctaactttatcctgttgtggtcagagaagacactttgtatgatgtctatcgttttaaatctactgagcttttttccttttttgggacagggtctcgttctgtcagtggtacaatggtacattttctttgtcatgaagtacaggctggagtacagtggtacaatctctgctcactgcagcttcaacctcctgggctcctaagcaattctcacgcttcagcctcccaagaagctgggatcacaggcacgcaccaccacgcccagctaatttttgtatttttagtagagatggggtttcaccatgttggccaggctgatgtcaagctcctggcttcaagcaatccacccgcctcagcctcccaaattactctgggattacagatgtgagccactgcacccagcccctattgagaattaatttgtgatgtgttatatggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttaaaagggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcagccattcatggacaaaactgcctttgcaagagttttaatatccaggcaggaggtggcaaaactctagcaaagcccaaaaccaaggagagctgctttgagaaggcaggtccacacaccagtgacaggttaccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcatgcctgcccaggaattcagtgatgcctttacatacccttggtaacaggcctgctgatctcagtctcagctatggacactaaagtagccctgtgactccattccagtcttgctttgccacagtctgggcacagtccagcccatcctgggacctggtgaaagacataccatccattctcctaataagaggaccaccaatcttgaactcaaatgtggtcaccaaagctgtcctgtgacttggctctagccctgctctactgtggtctggaggcagtcctgtcttcccatggacctacctagtaaaccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtaatatggctccaggcccacttgactgtgatccagtcaagggatccagcaggaaaaggtttgtacctgctgaaaccaatctataaagacagaaagagattgggcatggtggctcacacctgtaatcccagcactttgggaggccaaggcgggcagaccacttgaggccaggagtttgagaccagcctggacaacacggtgaaactctgtctctacaaaaaatacaaaaaaattagccaggcgtggtggcacatgcctgtgatcccagctgcttgggaggctgaggcaggagaatcatttgaacctgggaggtggaggttacagtgagctgagatcacaccactgcactccagctgggtgacagagcaagactctgtctcaaaaaaaaaaaaaaaaaaaaaaaagaagaggtatttgcttcttcatagacattaatgaaagtctgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgagcaaagctaaaagttcaataaagatacagaaataataagaaccaaacagaaattctagaactgaagaatacaatgaataaaatgaaaatgcaagctgggtgccgtggcggacgcctgtaatcccagcactttgggaggccgaggcaggcggatcacttgaggtcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtaagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataagtaaaaacctttgggatttataggacaccaccatgaagtgggtcaaacatattatggacttcctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtgaatttctcagcagaaaccttataagccaggagagaataggatgctatattcaatgtattggaagaaaaaaactgccaatcaggaagaccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacgcctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggccgaggcaggagaatgacttgaacccgggaggcagagcttgcagtgagccgagatcatggacactgccctccagcctgggcgacagagcgagactctgtctcaaacaaaaaagttcacagggaaaggtaagtatatagtcacattcataacactgtaatattgcagtggtggtgtgtaaatcacttttcactgtagtataaaagttaaaatgtaaaagtattaggcggcccgggcgcggggcagctgctgcggggaggcggggaggcggggggcctggccggacacccctgcgccccctccccgcacccgggcggagggcggcctcttccccctccccctcccccaccacccccggcagccgcctcccccaggacgcaggaggcgggcggaggccgggtccgcccagcgggcgacttgcggcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagcgcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttcacgggtactgcttgccaatctttggaggatgtgaagcctgcagagaaataaagtgtcgcccctctgcgcgtcgctccccatctgccagaatgtttctcatgaatgctcctccagtggttgctctccagcccaaatgggaggcctctgtcccgccagggagctttaggttccccgggtgcttctcggaggctgacaagggcgtggagagcatgtcggtgagcacccgggtgcagatgctcatcagcacgctgcagagcgacagggctgctaggggcaccagcgatgagcgcactgcgcagagggggcagagggatgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaaggtaaagagtggagcggcacagcccggggccagcggggcccagccatgcacagccttccagggctgcgggcggaggcagtagatgtaagcgggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggagcgccagcaccgcaaggaggggaaagcgagtcacgagcgccgtacaggctcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatgtgtgtagaagcagtcctggacattttcaagacgatcctgccggccctatggagggcagcgatgggtccctgtccgcaagcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaagtgaggccatccactcccaagaacatgcgggtggtggggaaagagggtggccaggatgccgaccgcagccaggggagagccgggcccggccatgaggggcgggacctttccatccagggcacagccagcgaggccccgggatgggagggcgccgctagggtgggacctttccatccagggcacagccagcgaggccccgggaggagagggcgccgctagggtgcccggtgacactcgcacgtcacagggccagggtaagacagacgaggcaaggcacctagacaagaagaagagctccgaagacaaaagcagttccctggacagtgacaaggacctggacacagccatcaaggacttgttaaggtccaagtgaaagctcaagaagaggtccagggagcccagggctgtgtgcaggaagaaggtcaggttcagcacctcccagacgcacttccaggagcggctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctggtgaggagacccgcttctgcctccgcctccgaagagaatctattccccagagagtcccagggcccagctcccagccctggctccttgtctgacaacagcagttcagtggacagcgacgatagcatcgaactggagattaggaagtttttggtggaaaaggccaaggagtcggtgagcagttcagaagttcaggcagagggccccaccgctctcgggacagggggcccagccaggccagaggtaccttgcaggaaggagccggccccactgcctggcatgtgcacatttggctgaagggcatcgaggcgtagggagcgcaggagcacagggcgcagcgtgcctgctcagccagggtgggaaggggctccccactgatccggcggaggggatcatgcgccacccaggaggaccagcggcagtgtctccgccaaggtctctcagtgagcaagagaaatgtttacgtttacaaagaccagagcccacgaggggctgagcctgctgccaaaagtgcttttggtcagcggcccagctgtgccacagcgggcaccgaggcaggaggagccagggggacctttcacgtggactgcaggaaccggagcttcctgacccccagcccgggagctgagagggatgctggagcccaggccaaccgcgccccgccctggagtgactttgcccaccacagtcggctgcccagcccatgggcactgcgctccaaaggtagagatgcggcgtggagggggcggcattgggagagagagacaaggggtccgagggccccgcccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccctgtctttggaagcccacacttgctggcgaagaaggactgcggtcaccggccaagcaggaaggtacagacggggctgagtttgcacaacaggaagagctctggctcggaggaaaggattttagacctgaggtatccacgaagggtcaatcagtagagttgaccaggaccaggacaccttgggcagggacaccagtgacttcagcaacacctccgcagaggtgttgctgctgcagtggcggcagctcagtagtgaaggtataagacctcgagctgtgggttcgcgtcctgggttccatgcattcgtggaaagcggcatagccgacgtgtatctgtgcctgtgtgtgatggttctgtggttgcagggaggggaaacagtctgttatacatagtcttgtatatatgtataccaacacgaaacaatgcttttatttaacagatgtgtcctggtaaatatgatttttgtagattttgtacattatttaaagtgatgaaaaatgtttttggaaaatactgttggtcaattttgtagggtgttccttaactgcagttttctgtgttctgcatacaagtcttagattagaaaacatttggtttttatcatcacaaccaggtttacagggactctgatgttttttggttggttgctggtgagaatggccagcgctggctgcaggggtagccttaggaaggccgaggtgccctccccaggaatcgctcacatgccccaaagtgtccgtcaggaagttcctgggacagcactttttatacagaggacacccccccaccaccgcctggcttcatggtccttggaggccagagcacatctgaaaactacaggaacggaaaaccaaactccgcatgttctcactcataagtgggagttgaacaatgagaacacttggacacagggcagggaatatcacacactgaggcctgttgggggatgggggcaaggggagagatagtattaggagaagtacctaatgtaaatgatgggttgatgggtgcagcaaaccaccatggcacatgtatacctaagtaataaacctgcactttctgcacggctaccccagaacttaaagtataattaaaaaaaaaaaaaacagaaaaaataagtagagattaaaccagtaatgaaaaatctcccaacaaagaaaatcccaggaccaaatggttttactggtcaatttcaacaaacatttaaagaattaataacaatccttctcaaactcttccaaaaagattgaagaaaagggaacacgttgaaactcattctaagaggccagcattatcctgatatcaatgccagataagaacactacaaaataagaaaactataggtcaatatccctggttaacatagatgcaaaaatcctcaatgaaatactagtaaaccaaattcaacagtgcattaaaagaattattcaccatgaatccagtctctaccaaaaatccaaaaaaaaaaaaaattagctgagcatgctggcgggtgcctgtggtcccagctactagggaggctgaggcaggagaatggcgtgaacttgggaggcggagcttgtagtgagccgagatcgcgccactgcactcaggcctggatgacagagcgagactccatctcaaaaaaataaataaataataaataaataaaaaacaaaaaaagaattattcaccaggatcaagtgggatttatctctggcatgcaaggatgctttaacatacaagagtcactaaatgtgatacaccacatcaacacaataaacgataaaaatcctttatttttattattaaaaagcacttgataaaattcaacatcctttcatgattaaaaaaaacaacaaactgagcaaattaggtgcagaaggaatgtacctcaacataatgaagaccacatgtaacatactcaacagtgaaagactgaacgttttttcctcgaagatgaagaacaagacaagaattcctactctcaccatttctcctcaaaataggactggaagtcctagccagaacaattaagcaagtaaagaaataaggatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatattgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataagtaagttctggagagctatacagcatagtacccacagaaaatgttactatattcttaaattgtttaattaaaaacttttattattattatttttttttagacagattttcactcttgttgctaaggctggagtgcaatggtgctgtctcggctcactgcaacctccgcctcccaggttcaagagattctcccacctcagcctcccagtactttgctcagattataggtacccgccaccacgcccagctaatttttgtatttatagtagagatggggttttgccatcttagccaggctgctctccaactcctgatctcaggtgatccgcctgcctcagcctcccaaagtgctgggattacaggcgtgagccaccgcacctggccattaaaaacatttttttatacaataataataataaagaggcagaaggaaattttaaaaggtgatggatatgtttataggcttgatgataatggttttatggtgtaaatttatcaagatgtgtacgttaaatatgtacagtttttatgtaaatcattcctcaacaaaatggtttaaaaagtaataaagtaattactgataaggggggacttacttctggcattttgctatacattttctatatgccttacagcatttttgtccatttcctgcatgatctcatttgtatttagttgattttttgtagcgaagtgttttaattcccttctcatttacttttttatgttatataatgttttatttgtggttaccatagggattacacttaacattctaaagttatagcactctaacttgaattcataccagctatatttcaataatatgcaaaaactctcctcacagttttgccactcctctttcagttatcaatgtcacaaaattacatttttgtacattgtgtgtccataaacataaactaataattgtttttaatgcatttgtctattaaattatgtagaaagcaaaacatggagttttaaaccaaagttacgataatactagatttaatattttcccatatatttacttttactggcatctttatttcttcatatggctttgagttactatctagtgttctttcttttcaacctgcatgattctctttaagatttcttgcagggcaggtctaatggtagcaaacttctcaactttggtttatttggggatttcccaatttcttcctcacttttgaaggacagttttgctggatataggattcttggttgagaggtagtggttgtttttcttttagccctttacatatgtcatcccattgtcttctgttctccaaagtgtctgatgagaaatctacttataatcctattatatattcctagcatgtgactagttgcttctctcttggtgctttcaagaggccctactggctaattataatgtctcagtatgagtcttttttttttcatcctacttggagtccattgagttttctggatatttattttcatgtctttcatcaaatttgggaagtgttcagctttttttttttcttttttgagacagagtctcgctctgttgcccaggctagagtacagtggtgtgatcttggctcactgcaacctctgcctcctggattcaagcgattcttctgcctcagcctcctgagtagctgggactacaggtacgtgccaccacgcccagctaatttttttttttttaaacggagtttcactcttgttgcccaggctggagggcaatggcacaatctcggctcactgcaacatctgcctcctgggttcaagcgattctcttgcctcatcctcccaagtagctgggattacaggcatgcaccaccacacctggctaattttgtgtttttagtagagacggggtttcaccatattggccaggctggtctcgaactcctaaccttgtgatccacccaccttggcctcccaaagtgctgggattacaggtgtgagtcaccgtgttcagcctcagccattatttcttcaaatgatctctctgcccctttccctctcttcttttgggacttccacaatgtctgcttgctattcaacaatcgtccttatttctgttcctctgacttgatcatttcaagtgtcccatcttcaaattcactgaatctttcttctgttgctcaaatctgcttttgaatccctctggtgaacttttatttcaatcactacacttttagttccagaatttatttattttttttctttttaggttttctatctctttattgatattcccattttgtttacacataattttactgactttctccacatcttccttcagttctttgaccatctttaagaaagttgttttaaagtatttgtgtagtaggttaccatctggtctttctctggaacagtttctgttgttgtttttcctttgaaataccatattttcttgttttttgtatgccttgtgttttgtattgaaaactggacacttaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagtcataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaaaactggacacttgaatataataatgcagtaactctggagatgagactctcctcttcctcagggtttgctgttttggggttttgttatgttttacattgttgtaggttgtctccatgctgaggatcaacctgagttgtaagcttgaggtcttctcaggtctgaagctgctcctttccctgggcacacactcctctctccaaggatgtgtggtaactttaatttcctctgtgtatgccattgcttttgagtgtcctagtctttaatgtttggctcccaaaaaaggaaaagagaacaacgaaggggaagggaaatggggttctggccttttctatctcctagaagttgcttcagtctggtaagggcttgcagcagtggagtggggagttgtgagcaataatggctgccggcctctgtgtttgcccttccataatcaaaagtagcaatcaacaaccagaacgcagatgctaacacttggaggacagagtgcttatcgcccatgattgttcccacaagtcttagcccaagaagttagaagtggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctgtaagaaattaaggattcgtttgttggggagggctgctggcatgcttgaaaagtactgtgacggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactagatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggatacacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgagcattactgcctgagctccgcctcctgtcagatcagcagcagcattagaccttcacaggagcacaaaccctattgtgaactgcccatacaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggtgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaatatatatatatatattacaaaatttaaagagagtggtacaccagtaaaggacatttagcatgaacagaggttgcaggactggcagatgctctgatgagtcagggagtacttggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgttttatagttaattttttttaatgagtagcagtactacactctaaaatatgaataaaatctatagtattatacatactgttgatccttgaacagtgcaagggttaggggaccagctcctgtgcagttgaaaatccatatataattctgggctatccccaaacttaacttaatatacgatatatatcatatataatatatatgatatatatcgtatatattacatatgatatatatcgtatataatatatacgatatatatcatatataatatgtatgatatatattatacacaatatgtatgatatatattatacacaatatgtatgatatatattatacacagtatgtatgatatatattatacacagtatgtatgatatatattatacacaatatgtatgatatatattatacacaatatgtatgatatatattatatacaataagtatgatgtatattatatacaatatgtatgacatatattatatacaatatatgatatatattatatactatatgatatagattatatacaatatatatgatagagattatatccaatatatatgatagagattatatacaatatatatgatacagattatatacaatatatatgatacagattataaacaatatatatgatacagattatatacaatatatatgatacattagatacaatatatatgctagattatatacaatatatgatatagattatacacaatatatatgatatagattacatacaatataaatgatatagattatatactatatatgatatatatgatatatcatggtatatcatatatataccatggtatatcatatatatatcatggtatatcatatatatgatatatacggtatatcgtatatatgatatagatgatatatcgtatatatgatatagatgatatatcgtatatatgatatagatgatatatcatacctgatatagatgataaatcatatatgatatagatgataaatcatacatgatatagaagatatatatcatatatgatatagatgatatatatcatatatgatatatcatatattatataataaatgaaaaatattatctataataaaagatatatattacataataaatgatatatattatgtaaaatatatgatatatattatatattatatctgatatatattatatattatatattatatcttttatctgatatatattatatattatatctgatatctgatatattatatattatattatatataattatattatattatattatatattatatataaaatttatgatatatattatatattatatataatttatgatatatattatatattctatataatttatgctatatattatatattctatataatttatgatatatattatatattctatatcatatatattatggtatattatatataattatattatatattatattatatataatataccataatatatcatatattatataatatataatataatataatataatataatcatatataatatataatatattatattataaaatatattatattatgatatgctatatattacatattacattatacaatattttatataatatataatgtatattatatattatactttattatattacatatataattatacattattatatttcatatataattatatatattatattatatataatatctgtataataatatatattatacataatattatatattatgttatatataatattatgtataatatatattatacagaatattatatattatattaaatatattatatattgtattaaatataatattatatattatattaaatataatattatatattatattaaataaaatattatatattatattaaatataatattgtatattatattaaataaaatattatatattatattaaatataatattgtgtattatattaaatataatattatatataagggatgcaggatgtaaaaggaaattatatatatgttatatattatatatattatattatatataatatatatatatatttgggggtgccctatttcctatctcataacttattttaagaagcacagcataataatgtgtggacttgggattcagtttttgaaacgaaacactgagccttcgatgaccttcctgtacatctgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatataaaaaattagcctccgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaaattagccaggcatggtggcagctggtgtagtcccagtgtggtgtagccccagctacctgggaggctgaggcaggacaatcgcttgcacccgtgaggcagaggttgcagtgagccaagaaggcgccattgcattccagcctgtgcaacagaacaagaatctggtctaaaaaaaattatacatatataatgtatattatatgtactatatattatatatatcatataatatataatatatataaaatataatatacattatatataaataatatatattatatgtcacgttatatatataatatattatatataatatattatatataatatacattatgtacataatatattatatataatatatttacataatatactgtatacataagatatattatatataatatattatataaatgtattatatataacatattatatataatatattatatacctaatatatattatatataatatattatatataataaatatattaggtatataatatttactatatattatatataatatatgtaatataacatatataatatatgacatatataatatatatattttatatagaatatataatatagataatatacatattatataatatgtatcatatattacataaaatatatatcatatataatatatataacacatcatatatattatatataatatgtatgaaacatattacataataaatgacatatataatatatgatatatattacatataatatatgatatatattacatataatatatgacatatattatatagtatgtgacatatattacataaaatctgtgacatatattatatgtaatatatgatatataatatataatatatgatatataatatataatatatgatatatgatatatgatatataatatatgatatatgatgtataatatataatatatgatatatatgatatataatattatattacatataattatattatattacattatattatatatatcataatatattatataatatataatatatatcataatatattatagaatatataatatataacataatatcttacataatatataatatattatataatatatatcataatatcttacataatatataatatattatataatatatatcataatatcttacataatatataatatattatataatatatataatatcatcacattcccataaatatattatatattatattattataaaatacataagcctatataatgttatatataatataatgttatataatattatagaatataatattatataatatagaatattatattatataataatatatgatattattttatataataatatatgatattattttatataataatatatgatattatattatataataatatatgatattatattatacaataatatatgacattgtattatataataatatataacattgtattatataataatatataatattgtattatttaataatatataatatattatataataatatatattatattatatattaatatataatattatataatataatattatataatgttatataataatatataatataatattatataatattatataataatatatgatatattatataataatatatgatatattatataataatatataatattatatttaataatatataatattatataataatatataatattatataataatatataatattatactatataataatatataatattatactatataataatatataatattatactatataatattatataatattatattatataatattatataatattatattatgtaataatatgtaatattatattatgtaataatatgtaatattatattatgtaataatatataatattataccatgtaataatatataatattataccatgtaataatatataatattatatcatgtaataatatataatattacatcatgtaataatatataatattacatcatgtaataatatataatattatatcatgtaataatatataatattatattatgtaataatatataatattatattatgtaataatatataatatattagattataatatacattatcttataatatattattgtataatatattatatattatattatatataatattatattatatataaaatatatattattttatacaatatattacatataatatattatataagatattatatatatcttatataatatattatatgtaatatataatttatattatatattatcttgtatatataattatacatattatattatatgtaataattatatataattatatattatattatacgtaataattatatataagtatatattatattatatgtaataattatgtataatatatattatattatatgtaataattatatataatttatgtattatattatatgtaataaatacacataaatatatatattttattatatataatatatataattgtatattttattatatataataattattgattatattatatattaattatattttatattatttttaatattaattgatattaattaataataaatttaaaatattaattattattttatatattatattatattatatattatattatatattatattacattatatataatatatgttatattatattcttatatattataatatataatatattataatatatattatattatattcctatatattataatatatgatatattataatatatattattatctaatataatatattatattatattatattatatatattatattatgtataatatataattatgtattatattatatataattatatataattatatatatattatattatattttattattatatatattcatatatattatattatatataatacatattatagtatacgtaatattatatataatataaggatgcaggatgtaaaaggaaattatatatatgttatatatataatatatattatattatatataattatatgtatatatatttgtgggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactacaaatacaaaaaattagccaggcatggtggcagctggtgtagtcccagtgtgaattgggattcagtttattcagtttattcccaaattccaaattatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagggctttgaaaacctgtttacttgttaatgctgttttgatgtattgtgtctttgttctcccgacccatcgtccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctactaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttactcaaacggtgctaatgttgaaggcctgaactacaacctctatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaacgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcgttatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttatgtgtgagcctgaagtgggggataaaagaggtgattagctcccctgtgccatgtttctgttatgtgcgtggtggaggaaaattacacaggaaggtgatggagagaacagagcaaaggattggacaggtccattgaacccataagactatggtgaggttagtgaatgagactggtcattttaggtcaaattttacccagagctggtacagccactgccgattcttagccagaccttattgcaggcagctctgatcaatagtcaaggaggcagtgggggttgcagactttattcattaaatcaccaaagcaccagcccacacggccacttttccagttaattcacagtagcttgcatattcaggtttgatcagtggaagggaagttactctttgcagactcatttttgacaatcattttgcggtgtcagaaggtctgagcagcctcgggaggcaagcagtccctggtccctcagtgtagtcactggaggagacagtcactgagaggcagctggcagggtgaagggaaaggggaggcaggccacagagatgacagtctttaagctgtcatactggtgaggtcaaggatctgaaagaggaaggagaattctttatcattaaggacctgtccttatctcaggcatttcctccagagcatcacctttgtccacccacacaccttgggctaggaggactggagaaagacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctccataaaccataaggcgtcatgcccacggaaaagccgaacaggaaagcatgctccactgccccggagccatccaagttccccctccatattccgccactgctaagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaagacatgagcttgccaggtccacatggcttagtggaatttgaatccgggcccccactctgcaccagccctgcactcacagtcatccggctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggccttctgtcagcaagatgtcaacagccctatctattgtcaatgcattaaccagcgtcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacaaaagcatagatctccctgaaagagtggtgctatattattacttttcaattaatatatttctttagagaattttaaattgacataaaaactgagcatatggccgggtgtggtggctcacacttataatcccagcactttaggaggccaaggcaggcggatcatctgaggtcaggagttggagaccagcctggccaacatggtgaaaccccatctctactaaaaatacaaaaaaattagccgggtgtggtggcaggcgcctgtaatcccagctactcaggaggctgaggcaggagaatcgcttgaacccaggaggcagaggttgcagtgagccaagatcatgccattgcactccagcctgggtgacgagtgaaactccatctcaaaataaataaataaataaataaataaaaattgactatataatacacgaagttcccatattattctgactcctcaccctcacttcctaatttcacctattagtaacatcttacattactgtggtacatttgctagaataatgagaacatattgatacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtatgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggattctagcgtgaccttgggaagattgcctttcaaggaattgatacatttcactgaggttatcagactgcggtcatagaactgttcataatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtgacattttcttttaatgtagttaaaagtatttttaattttctattgagacttcttcttttacccatgagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccacagtctaggcgagggggcatcaatggcagttctgctgtggcactgccctccttcttagcttgtcttgctctgtcttaggctccctcaaagatcccacccttcgggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaatcaaggaagatgtaatagttttccataaattagaataccctacatgtacaattaaatgaaatggctagtatagtcttgaaaccaaatccagataaggtaaattaaattctgtgatattttaaaatactttaaattctgactaatgtgagttaatctcaacatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgtgacaaccacttgaattaatgctgctttcacagcatatctcttggcttgttaaaaacccgacaagaatttccgtaacattatttttaacacctatattgggtgtgaacccaccataaagtttgcccactgaaaaggtctagaatttgatgctttattaaattgatactgtgtgcacccaacaccacgatctaatttaaatatgtttccctcacccaagttctctcttgcgcactggcagttaatccccactcccatctccagccctaagcaatactgctgtgacattccatctccataaatttcccacttgctttatagaaatggacatatatatatatttggaatctgacttccctcatttagcatactatgtttgaagttaattgacgtgttagcacgtgctggtcatgtgttttccttcatagtctgctgtgtttattcatacagatagtgtttattcatttatcagttaatggacatttaattgttttgttattttctttgatgagtaatgtagctttgtgcattcatatacagtcatgtaatgcataatgacattttggtcaaaaaaaatttttttttttctgagacccaggctggagtgcagtggcacaatctcggctcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacacatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatataacacattatttatcatttgaaccttttaaccaaagtgtgcactccgtggcattcaatatattcacagggttgcataaccaacaccactatctacacccacaattttgatgatttcttacaaaaccttgtccacaataagcaatatagcgccttccccctatttccagcccatggtgattcctatcccactctctcgtatgaatttgactattctaggcacttcatgtaattacaattatacaatatattccttttgtgtctggcttatttcactaagcataatgttctcaatgtccacccatgttgtatcatctatcaaaatgatgttcattttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaggagtagagttcctgggtccaacaggggttctatatttaaccttctgagccactgcagactgtttttcacagtggctgcaactttatccatttctaccatcaatgtatcagggttacaatttctttacatccttgttcacacttattttcctttaaatcatcctagtaggtgtatattggtggctgcttgtgtttttcatttgcatttccctaatgactaatgatcctgagcagcttttcctgtgctactatttgtggctatatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcgctgcagagttaaaacataccagcattcaacccatgtctcctgtcttgaagtaaactgtcgtatgttggctggcctgaacaagcgtagatattctccatcctcagttaatatgcatgcatgacaaagaaaaggaggcctggatgaaaaaatattgtgtgattaataattatgctttaattaattttaaaggatataatttcagtacttctaattctcccatcagcagttataacaaaggattagtgaataaataccatagactgttttgcctagaattgaatccaatctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaatagctcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatccaaaatggcatttagctatgatggcttcaggttgtagactgtatccttggggtccttgtccttggaagcaatgtcttctccttggattcagtattttgcacttgccaacctacgtggacctgagagatccgccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcgtgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaacagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggcctccgtggtcacacaacccagggcagttataggttcatctccccacggacaggcatagtcatcagtgtgtcaaaagcacaaagatccccaggtgtttggctcagctcaccgatccttttttttttttttaacttttcagttcaggggtacatgtgcaggatgtgcaggtttgctacatatataaatgtgtgtcatgagagtttgttgtacagattattgcatcacccatatattgagcctaatatcagttatttttcctgatccaccctctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacaagtgtaaatctcgtacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaggcaaaggcctctgtttctcatttctttcctgttcatctccttggtcatccttcttccgcaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgcccagggcatcgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccatggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaacgaggatgctgtacacgacatcgctaatgaggacaccatacaaggcatcggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtatacgacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacgtcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctgtatatgacatcgctaatgacacccacaaggcatgctaacgaggacgctgtagacgacattgcttataaggacaccgtacaagacatcactaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcatattttctctctcaagttgtcgagagactatcagatctgtgtgacgtgtatggcatcatttcaccctcctaatgttttcttttctataattgcaggagccattgacactggagaatgatacctaccctgaaataactcacttcctgagaaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaacaaaacaggaaatatgtgtcatattggacttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagaattctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctagcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtataagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccatttgttctgtttccagtcttgctcttataaccaatgctgtagtgaacagcactgtgttgagaagtggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacatgctctgtcacctagaggtgcagtgcttgggaaggccaaccttggagggttgcctgccagctttacagtgacagaggtgttgagagggactgaccaccagtgcagaaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgccctgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagcagaaaggccaggagggtggctggaggccaggctctgagtcattctccatgtgatggaaacagccggagcccagtgggcttggaggtacaggatgcggtggctgatgacagaacaatgtggagagaggtgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcgactcctatagtattgaaatgcataggttagcatttttggccaatttactcagcattctgggttaaaggcttttatttattttatttatttatttatttacttttgagatggagtttcactcttgttgcccaagctggagggcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgattttttttctaattgaggtattatgtacttttcatttactaattattgtttacatttgaagtgttttatgaattaatatttaattgcatagatgaagattactagttataggcattttactaaccaatactcattaagcatagcgtggattcatatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccggatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctttacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccgcccaggttggtgccggactctccctgggcccccctgttctctcaccagccacatccattctccccccagaggcgctagtgactgtgcgtggctttccattcccaccacgtttgtctctaaccccagtggcagatcagtgtaagaacacagctgagtgctcctcgcctccttgccccttcaagggctcctcaccacccaccagatcaggtgcaaacttccaagccttactggatccctttccacattctgagctccgcctgccttcccatcgctatccttccccacctgcctccctggtagagaaaagcagagtgtgtgatgctgtctgaatgctgagcacggccttttgcagccagtccactgtgtacgctgcccctatcggagacctccaccttaaccctttccagcctgtaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgctgaataaatgaatagcagttacaaaacactagattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggattaggccttcatctatccatcaccttggagaggaacaaaataggtggcctgggaagttaagcactatgtttctattagttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagaccgttcttgctctgtcaccaggctggagtgcactggcacaataatagctcaccacagcctcgtgctcctgggctcaactgaccctcctgcctcagttttagcttcctgagtagctaggactacgggtgtgtaccaccatgcctagctataataatttttatttttttgtagagatggagtcttgctttgttgcccaggctggtcttgaactcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctgcggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagattgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagctaagaaacttacaaagtctctctgccttaacttcatccaccttttttctctccagcttttcctcggtagttaatgattataaaaatatttattggctcatgcctgtaatcccagcactttgagaggccgaggcgggcagatcacgaggtcaggagattgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttacaatgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaggctgaggtgggaggatcacctgtgcccgggagttcaaggctgcagtgagctatgatcacaccacagtgctccagcctgggcaacaaagcaagactccatctctaaaaataaaataaaattaaaaaaaaagatcttcgctgtaaaagaggtacgctcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcaatgagcctagatcgcaccactgcactccagcctgggtgacagagtgagactccgtctcaaaaaaaaaaaaaaaaagaaaaagaaaagaaaagttcttctgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccctattggtcaggctggtctcaaactcctgacctcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcagtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccaaggtttaagcaattctcatgcctcagactcctgagtaactgggactacagaaacttgccaccacgcagggatttttttttctatttttttgtagagacacagtttcaccatgttggccaggctggtctcgaactcctgactttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccggggcatctcggcctcaatacctgggtgagcacagtcatgtccaggccagggctgctggtcgaggtccggccccatctcttccagcagaaagggagtaagcttgcagggcggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgagaccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaagaaataaaacatactgaaatatgtatgggtacagttatatatctgggatttgcactgaaataatgtggggtagagggaagcaggaaagagtatacatgaaatgagcttggccataagattgttgttgaaattgaatggatactcggggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggtgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagtgaaggatgcatgttgtaagctctaaaataatccagtcatcttttaaaataactctaagactgcacagttatgaaactaatagagaaggaggaaattaaataataaaaataataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataaggatacagagaggtggaagatcatgaaaaatatgtcatgcatgtactaaccaagaaagctgtataacttttttttttttttttttttttttttttgggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagagacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagactgtgccattgcattccagcctgggcaacaagagcaaaactctgtctcaaaaaaaaaaaaaaaaaaaaaagaagttactagctagtttcggtaattcttaacaaccaggaaactggaatgtgaaagtttttcagagaaactaaaccaatagattatacatagagagagatttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtattcgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttccttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccacccccctcggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcacaaaaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctgacgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggacagatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagcggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgagatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgctcaagccctgcaggtgctgaagcccacacacacggctcctgcttactgggccagtgcacgtgcacacacacacacgtgcacacacacacacacccacaaatatacccacacacaatcacacacattcacacatacccaccccccatactcacactcacacatttacacacacccacacacccacactcacacactcacagtcacacacaccctcacacagcgaaacacaatcacacacattcacacccacccacacccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactcacacataatctctcacacacacacatgctcacacacacacgccttctccaggaggggctggctgccaaaggccacccagcttcctcccacgtctcactcaccgtacaatatttgagaagaccttggagtcagcagcaacagcggtgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggcccgacctaccgcccaccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggcttcccagtctgcacagaggacagggggtcttgacagcatcaaatgctagtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtctacacctggagtctgggcccctccatctgggcagcagagaaactgaggcacagagacagactgtgtccttacagggcacacagcctgccaggcccctatgtccggccagagcccctggccagcctgggctgcagtgattgtttagaggtaggctgttcccacggctgcctctcacggtaggggggcctgcggacgcctcctcccgcccccacccgactcccaagcctcagtgacattgctcaaccaggagctgaagtgcattcctgggctcaggccagcccacccaccgacccgctgcagtcctggaagcccagaggcctgggcagcaggaacagtggagacagcagtgtgggggacgtccccctcctctccccaccatcctcgtcaggcagaggccagggtgcagggaccgcccgagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgttgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttggctctgtggctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaatttttttaaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctctggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcactcagtagccagcaggttccccgcctttcctggagtccgaggcagctgcccagccaccagccgtgcggacgatggcttgcaccacagcgatgaaggtggacgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggccctcatgtcacaggggctccagatggcccaggcactagagagaggacaccaaccattgtccactctgtgatgatccaggcctccagcccaggatgccctgggaccccacaccgtgactcagtttctccaacccccggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccggacctccaccccatacctggctggatgaaattggcaggtgaggggggtgccccaaactcattggtgatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggggcacaggtctcagaaggcccttgactgtgactctgaccgcaaccctctggcacccacaaccttccgtggctccccaggacccaagggcaggcccaggaccttgcatgaccagtctgactccctgtctctgtcgcgttccagcaactctgaatgtctgtctgcctggtcctcagcctccagacccttgccacattcaatcactcattctttcatgcaaaaaatatttctagaatttgcactgcatgcctggcactggggaatcaacagggaacagacacttaagtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaggacctcctaggtcccataacaactggcttttgctctgtgccatgcaggcttagggcagaggaatgaggaggctggggagtgttttcacagggtccctctggcagctatgacggggataaggataaagcccaaaggggaggctgtgggtatcaaccaggcaagagatgatggcctgggtgggagaaagagaagaatcaagcatggtgccgactagcgaggccggcagaaggggccggtttggggatggtcaggagcttgattttggatacttcatcagacccaaagagcatgggtgcacgtataaaaaaaataaataaataagcatgggttcacgggcaagggcgggctgagagatgaacatggaggtattgacattgagtggctgctggatgccatgagcctggccaaggtccccaaggcagtggcgaggaggagatgaggaggtcaaagaggagacagagaggatggacccgaaggccgaagaaaatgcctcaagagagtttcaacaccgggcgcggtggctcacgcctgtaatcccagcactttgggaggccgaggcctgtaatcccagcactttgggagggcggatcatgacgtcaggagatcgagaccatcctggctaacacagtgaaaccccgtctctactaaaaatacaaaaaattagctgggcgcggtggtgggcacctgtagtcccagctacttggggggctgaggcaggagaatggcgtgaacctgggaggcagagcttgcagtgagccgagatcccgccactgcactccagcctgggggacagcctgggggacagagcgagactccgtctcaaaaataaaataaaataaaataaagtttcagcaacaccccacggattagctgaccaatcccagggaaaggtgttctgtctgaatctgccctcaaggaaacagaaaggcaaatccacgatgtgggacattttccaagactactgccctgggctttaaaaatcaacaaaacaggccaggcacggtggctcatgcctgtaatcccagcactttgggaggccgaggcaggcggatcacgaggtcaggagatcgcgatcacggtgaaaccccgtctctactaaaaatacaaaaaattagctgggcgcagtgtcgggcgcctgtagtcccagctactcgggaggctgaggcaggagaatggcgtgaacccaggaggcagagcttgcagtgagccgagatagcaccactgcactccagcctgggcaacagagcgagactccgtctcaaagaaaaaacacacctgtaatcccagcgctttgggaggctgaggtgggaagacagtttgatcccaggagtttgagaccagtctgggcaagaccctgtctctaaaaaaaatacaaaaattatccaggtttggtggcacctgcctctggtcccagctgctcagggggctgaagtgggaggattgcttgagccctggaggttgaggctgcagtgagccaagatcacaccactgcactccaacctggatgacagagactctgtgtacaaacaaaaacacaacaaaaacaaaacagccaagggagcctactgtaggtaaagagaagggacagcaggttgtgtcaccccgacatcctgctgtgctatgttcaagtctcacttttgagacacaccctgaggtgcgacatcagtaacctactgtggaatccctcagaaaaacacgaatcccaatagatgtgggtggagacggagagagttaggaaatccggcagaaatgtccacactgcagaatccaggaaaagggaacattgatgcttgggcagttttgggttttttttacatttttgtaggtgcgaaaatttgcaaaatgaaaactcgaggagagtgtggtgagctgtgtgagatgctgctgagtggggcctgatggggaaactgaggctggacatggcgatctggtggcatggggatagagcaggggaggggataccctgaagggagagaggacatagcccagccatgtttgctctaagaggagcaaaggacagaaggaggcagcagatagaagtttctagagcaacaacagctgccttttttttgggaataatccgtgataaagaaataaatcatcagaggcagacaggagcattgtaggaacagcaccccgagccagcgagtagatgaaggagctggccttagccaaaaaggagggcagagggacacgctgcagtggctctgtcccctcagagagacaagacaccaggtcactggctgcagcgggagtcagaggtgcagaatgctcacagggaaagagaagacaccacccgggcagctgacgcccctcctgggaggtcactggtcagtgtgggggggtctgcagatccgcccaggaatgccaaggacccaagtaggtaaggagggatgtgaggatcctcagcgggaagggatatgacagggtcttatagggacccagcatggagctggggcaactactgggtgagtgggtcaggtggtgcagggctgagggtggcatctgggaagcgttagtttggagtgacagggagtgggtggccgaggtctctgttcacctggccctctccctttcacccatccatctcaccatgcccgagggctgcaatgcccccatgcattcctcatctcagcactgagcactcaagaaccacagcatgtgcaaaggacctgaggtaggagggtggccactaattccccacactgtcagttctgtggggcagaagccaagactgggggtcacccacaagtccatccgagcacacagtaggcccgcaatcaaattctgtggcaggaatggattcataaagcatatgtgaggctgtagccaccctggggagcccacctgatgcctctacggcaggccccacacccacagtgggccagcccctgccccttacctcagtcacatccacaaacttggggtccccaagcagggtcctcttggcgtaggcaaaccggaaagcctctacgatgcggtggtacgtcaggcccttctgctcgggggtctccacgctctcccgggagaagttgtaccctggttgatcagagccaggtgcatgttgctgagccccagaggctctgaggggctcagagggttaacacctgcctgagccactttgcccacctcaaggagcgtttaataatcaatagcagcagctgcttcagaaggctgtggtgagagtgaagtaaggtgagggctcccgagcctggacctcacgtcacgcatcagctctggccattcaatgaccaagtggcagggtcacccactggactggggtaccctctggaccggccctgcagccctgagctcctgcacctctctccctcctgatgactcctgttcctcctccaacccttgagcattgcccgcttcagccctgttgctctgcactgcctccttcaggacatggtgagctgtgacgcagggacacacctcaggagctcagtgatggaaagacgtggcatggggggcgagcagagatgcaggaggggtggggcgtggggagagagaggcagtgtcatgggtcctaccacacggctgtggtgcgaccactcacctttgaggatgttgaggatgagggccagcacgggcccgctgagccgcgcactgggcatgtacagcaccgcgtctcccaggctgatgttcagcgggtgctcgatcagctcagcacagtagttgttcaggtcctcagctgtcacaatgccccctgcaatgggacagcagctcgaatgggcgctgggatggggctgcaccactgcgtggaggatggagctgcaccagtggtgttgggggcaggcatggctgcaccatggtggtggggaaaagcctgtacctaccagggaggacagagtgcactactggaggggtgggactgtgccctgggagggggccacaggcaacctcacctccttgggaacctcaccagctccggcactcctgtctccctgacactgctcaccacccgacagctgggctggggccacctgccctctgcctgcttggcttactggcttcctgtctgccttctctcatctgtggccagagagtgttttcttttttctttttttttttagagatacgatcttgctctgttacccaggctggagtgcagtggcttaatcacagccttgaacccctgggctcaagtgatcctccagcagaccctccccagtagctgagactaaaggcacaactacacccagcaaattttaatttttttgttgtgttttgctatatttctttctttcttttttttttttttttgtgagacggagtctcgctctatcgcccaggctggagtgcagtggcgcgatatcggctcactgcaagctccgcctcccaggttcacgccattctcctgcctcagcctcccaagtagctgggactgcaggcacccgccaccacatgtggctaatttttctgtatttttagtagagacaggtttcactgtgttagccaggatggtctcgatctcctgaccccgtgatccacacgcctcggcctctcaaagtgctgagattacaggcgtgaggcaccatgcccggccgggttttgctatatttcttttcactatgctttgaattttttgttttcttgttccccacccccacccccactatatttatgtagattctcaatattttttttgtagactcactatgttgcccaggcttgtcttggacctcctgacctcaacttctacctcaggctcccaaagtgttgggattacaggcatgagacaccaagcttggcctcagagggccttttctctcttttttttttttgagatggagtctcactctgtggagtgcagtggtgcaatctcggctcactgcaacctcagccccacaggttctagcgattctcctgccacagcctcccaagtagctgggattacaggcacaacccaccatgcctgactaattttgcatttttagtagagacagggtttcaccatgttggccaggctggtcttgaactcctgacctcaggtgatccacccgcctcggcctcccaaagtgctgggattacagacgtgagccaccgcacctggctcagagggccttttctaactggagaattcctgccggtgtccctgctgcttggcctcttctcctcacgatgaatggatagagggagggagggaggctcttaattctcctggagtcagctccagacagggtattggcatgccaatttccagcctcagtggtaaaggtcgacacgctaatcaccctcctccatgaaacagtgacaaaaattacctgaagaaagccacagccaagctccaggcccctgccccacaaatccccttccccatgcctctctcaaggcgaccctcatcccttgtaaccctcttggtgaatcaaagcgccctctactgggccttagcccagctgttcctctgctaggaatcccttcctctctctgcctaacgaagttatctgcagcccagccgccacctcctccaagaagtcctcctggatcttcaggctgtattctagtgcttccctagccctggctcttgcctacacctgcatttaccccaacagggacttgctctcctggactgtgtggcctctcttggttttgatataagcaggagctgtggacccacatggccagtcactgaccctcctccaccaggaacttcctgcaggctcaggcaagacaggaggaccccatggctctgggctacagctcagggtttccactgcagagttcctcacccaggtccttgaggttacccactcaccagccgcctggatgtccttcacaatctgggccatgaggctgccgttgtagaaggcctgggcaccctcgatggccagcatctcgtaggtgtcagccagccgcggcagggtcagtctctccccctcccgaagcacctttctatcccggcagaacacctcactggggcagagggggctcatgtgaggcagcaggtggggtggactcagctagaccaccccccacacctgcccacacaggagaacggagcagaacaggggcagcgcctgtcacaggtgggtggccctgtcactcagcgctcgtcctcctagtgtcccttccgggagcctcctagtgtcccttgccactcaggacacgtggccagccacagtggccactgggaccccacgctcagaatgtgtccccacacgtggtgggaagggtctgtatctcctcatcccattatcagcacagggtcctgaaggcagagggccgctccactgctgctacggcctgcaaggtccttgggctgtgcctgccctgcctgtgtcagggggccgcacccacagacataccacaagacaggctgctgctcgatgacggtccgcttgttttccaggactgccgccaagcccttgcccacggggaagccctggcgggccagctggatgctgggctggaagaggcgagcccagggcagccgcccatgccgctggtgtgccagctcatagcctcggatctccccaggcaccgccaccgacagccctcctggggagagagagccacagttagtgaccctgagtgggggacatcgggatctctcgcaggcagcatcccaggcacagtccctgactcgctttacagatggggcaatgaggcttaggaggaaagatttttttttcttttttgagttggggtcttgccatcttgcccagcccaatctcgaactcctggattcaagcaatcctcccacctcagcctcctgagtcgctgagattacaggtgtgaacagcacacctagcagaaggggatttttaatttttaaatttattttttaattttaattgtttttttttaggaggggatgtttaatttttttttttaggaggggctcagcaggtaggagtgtacatggaccagggatgtctgaggagggcacagcaggggaagcagtagcatgcggctgggttttgctgtcccaggatgaggtgtctgtctgtgcaggtgcctgcatgtctaaaatcctgtgccaggccagaccccctcccatctcgctgaccacaaggccttatcctgtaagactcatgggctccaccagaatgtgccaaaacaagagcagatcccaccttgaccgaggtcaagcacaggccaccttcaagacacagccagccccaagaaagggctccctgcctcttttctactgccccagagaggcaagactgagccttaatctccgtcctgtcccctctcccagcctcagtttctgcatccaactataagggtttttgtttgtttgtctgttttgagaccagggtctcattctgttgtcccagctggagtgcagtggtgcaatcatggctcactgcagccttggcttcccaggctcaagcgatcctcccacctcagcctctgaagtacctaagactacagacataccccactgcacgtggcttttttttttttttttttctgagatggagtttcactcttgttgcccaggctggagtgcaatggcacaatcttggctcactccaacctccacctcccgagttcaagtaattctcctgcctcagcctcccaagtagctgggattacaggcatgtaccaccacgccttgctaatttttgtatttttagtagagacggggtttcaccaggttggtcaggctggtcttgaactcctaacatcaggtgatccatcctcctcagcctctcagagttctgggattacaggcgtgagccaccactcccagcctaattttttatttttattttttgtagagacaggggtcttgctacgttgccaagactggtctcaaactctggcctcaagcaatcctcccacctcagcctcccaacatgctgggattacaggtgcactcagcctataaggggttttgccttccagttctgacttttgaggaggtcattggaaacagacccctgggcctgcttccccccgagccccactgcccatatggacactacagacactgaccctttgcccagaaaggtacaactatggcctctgcccccagggactctcctgctcttgcgagagatgatggggccatttgccttggcttggcggctgtggctctagaactgcctctcccaccctgaagcctggcacaagtttccaagagctggtggtttcaattcctagaagctgcacatatatcccggaaggtctgacacccagcatatgattccttccaccttgtagttagacagaagttcttttttgttttgttttttttttctttgtttgtttttgagatggagtcttgctctgtctcccagactgcagtgcagtggcatgatctcagctcactataacctccgcctcccaggttcaagcgattctcctgcctcagcctcccgagtagctgggattacaggcacaggccagcacgccaggctaatttttgtatttttagtacagatggggttttgccatgttggccaggctgttttcagactcctgacctcaggtcatccacccacctcagccttccaaggtgctgggatgacaggcgtgagccaccgtgcccagccaagacaggagaagttctaatctttgatagcagaccagggtgacgatgcttagcaacagtattttgtatatttcaaagtaacgaagagagcactatggtgctaacacccagaaatgaaaaatattcaaggtgacggagactccaaataccctgccttgatcattatacactctatgcatggaacaagcactcacatgtacccataaatatagaaaatatcatgtatcaatatcagaaaaaaatctcctcctgacctcagcccaatcaggctctcatgccaccacacttgccaagttctctggtgacccccacactgccagacccagtgccccctctcagctttactgggctcatcactctccctgagagccgcccctgcatcccagcacctggctccacccgagtctcccccgcctgccatcctagctcctactctcccctctgtctttgctctctctcctggtggtctgcttgacatctgagcttcagcctccatttatgcactgacaactctcaaattgacctgctggcctggactgctcctccgatcaccagacctgaggatctacctgcctgcttgaagaaagcatctcaaacttcaacgtgcccaaaaccgagctcctgagtgtctgctcaacctgcttcctgagaaccctgcctgtctccattagggtcaccccatccttccaggtacagacaaaagatcaggggtccccggggactccctacacaagcgtcacacccaacccatcctcaaatccacaggctccacttccaagtgtgtctgtgcagcgtcagccacttcccagcaccctctccacgaattactgcagtgacctccggacaggtccccacatgctccctgccccttacacagcaatccaaggggtccatagaccagatccatccccttccagtcacacactccacgagcccccacttccctcagacaggaagcagaggcttcaccataacctaagagatcccgcacaacctgggccattccccttggatcacttgctgcagcctccccagctccccacagggctctgtccctgccatcacacctggatagcagaccaggagataactcccctgaccccatctctgcctctgggtctttgctcagatgtccccttccctgactaggtcaccctccatagagtcccagattttgaggccctccaggtctgtttttctacagcccgtaacacacccgcacttgcctagtttctcctcccacctggagtgtcacagatttcatctgccgtctttgtttttcaccccagcttcaggaacaacagctgattctttaagacaatgctcaatacattctagtcaaataaatggttttaagcgtccacaaggtgccaagcctatgattcccgcattctcttaccctcagcaacttcatgtctacagatgctgagtttctcagtgagtattaaaaacaaatgaaagattggtcgggcacagtggctcacgcctgtaattccagcactttgggaggctgaggcagggggatcacgaggtcaggagatcgagggaccagcctgggcaacacagtgaaaacccgtctctactaaaaaatacaaaaaattagccgggtgtggtggcgggcgcctgtagtcccagctactcgggaggctgaggcaggagaatggcgtgaactcaggaggcggaacttgcagtgagctgagatcgcaccactgcactccaacctgggcgacagagtgagactccgtctcaaaaaaaaaaaaagaaaaaaaaaatcaaagattgagtatgttgcagaagactccaaagggcaccacccaggacccccacctgaagtctaagacctgctatggtgagtgtgtcctgcccctccatcctccaactttttttttttttttttttttttgagacggagcttcgttcttgttgcccaggctggagtgcagtggcatgatctcggctcacagcaatctctacctcgtgggttcaagcgattctcctgccttagcctcctgagtagctgggatattacaggcctgtgccaccacgcccgactaattattgtacttttagtagagaaagggtttcactatgttggccaggctggtcttggactcctgacctaggtgatccatctgcctcagcctcccaaagtgctgggattacaggcgtgagcctgtgaaaaaaaggcccagcctttttttttttttttttttgacagggtctcactttgttgcccaagctagagtgtagtggtataatcatggctgactgcagcctcaacctcctgggctcaagtgatcctcccaccttagcctcccgagtaactgggaccataagcacacaccgccatacctagctaatttttttttccattttttgtagagatggagtcttgctatgttgtccaggcaggtctcctgggctcatgcgctcctcctgacttggcctcctaaagtgctaggattagaggtgtgagttgttgagaccctcccatcctccaacttttatctcacactctattgtgcctcctttggggacagacagtggcttcctggatggacagtggcttcccctcaggtacctggggaatttgggggcctcctccccacttaagaccagattagaaaagagagactccacctcacattctagagcgccatccccacaaatgaacaaatgagtgaatgggatgcctgttgaaaaggcaggatatagacagcctgggttcaattttagcttcaccacctcccagctgtgtgacctcagctgatttgcatgacctgtctgagcctcagcatccccaccctgtaaaatgggaatccacacagcatccccttgcccaaaggagcagggagggttgtgagaggctcgtgggtgaaaagcacagagcagagcatgggccccagtgagccctgatccatgaggtctgctagcataataattattctttccatgtgctgcacagagtggccccggaggccttagcagaaataacagaagctcccggccctttaccatggtgatgatggtcctgaccactcactgtgggagggtgctatggggacaggaagggatggggggtgctagaactgcccctgaaccctgacgggagcaggctcctgtgggcaaggccccttcccggtggctcagccagctctgcacccacgccccaagtctgccgcatggcttacccttctgggactgctccgagctgttgaacatgctggcaaaggccagcctgggggccacctcgcgggcattgatgacctcagcttttcctagaagaagcaggtaggcaggcccacccaccaaaaccctttatgccacgtgagcctgggggccacccagctgtgcctcggcccaacccacaccccctgcccctctccctctccgcttccgaggcactcatgagtggtgctgttgtagatggtgaggaagaggccaaccccgatgcccatgctgtgggcattcatgagccccacacacaacagggctgcaatggctgcatccactgcagagccaccgtcccgcagtgtgtccctgccatgtggcacataaaggcatgagaacctgcaggcttccaccctggccccgcatacacaccctgctgcccacctgcccaaaggaggatggaagagaagtccattcgagttttggggtttttgtttttagtttctttctcttttttttgagatggagtcttgctctattgccaggctggagtgcagtggcacgatctcagctcactgcaacctctgcctcccgggttcaagccattctcctgcctcagcctcctgagtagctgggactacaggtgcatgccaccacgcccagctaatttttgtatttttagtagagacggggtttcaccatgttggccaggatggtctctatctcttgacttcatgatccacctgccttggcctctttttttttttttttttttttttggagacaaagtctctctttgttgctcaggctggagtgcagtggtgtgatcttggatcactgcagcctcagtctcctgggctcaattgaccctcccatctcagcctcccaagtagctgggactatgggcacatgccaccatgcccagccaattttgtttgtttgtgtattttgtagagatggggtttcatcatgttgcccaggctggtcaagaactcctgtgctcaagtaatccacccaccttggcctcccaaagtgctggtattacaggcatgagccactgtgcccagcctttgttttatgagacagggtctcactttgtcacccaggatgaagtgcagtggcacagtcttggctcaatgcagctttgacctcctgggctcaagcaatcctcccacttcagtctcctgagtagctgggactacaggtaagaaccaccacaccgggcaattttttgtctttttcgtagagatagggtctttctatgttgcccaggctggtctcaaactcatggtctaaagcaatcctatcgcctcaacctcccaaagtgctgggattacagtttcttctttttcttttcttttttctttttttttttttctgagacagagtttcactcagttgcccaggctggagtgcagtggcatgatcttagctcactgcaacctctgcctcctgggttcaagcgattctcctgcctcagcctcctgagtagctgggattacaggcgcacaccaccatgcccggctaactttttatatttttagtagggacagagtgcaccatgttggccaggctggtctcgaactcctgacctcagtggtctgcccgcctcaaccccccaaagtgctgggattacaggtgtggaccaccttgcccagacagtttcctctttattaagcaaacaaatgtacatgacttttataattgggacaaaaagggaaattgctatactttattaataacattttttttttccctgctagagatggtggcttacacctgtaatctcagcactttgggaggccaaggtggaggatcacttgaggccaggagttcaagaccagcctgggcaatagagtgagaccatctctacaaaacagtcttttttaattagtcaggtatgatgcacgcctgtagtcctagctactcagggggctgaggtgagaggatcgcttaagcccaagagttcaaggctgcagtgagctatgatcatgccactgcactccagcctgggtgacagaacaagaccctgtctcaaaatatgaaaaacataatattttttctgtttaagtctttaggagggaacttatctttatatataacatgagataagagtctaaaatagaataacacagtagaagccaggcaccatggctcacacctgtaatcccagcactttaggaagctgaggcgggaggatcacttaaacccaagagtttgaggctgcagtgggctatgatcgctcccctatactccagcctgggtgacagagtaagactccaccttaaaaaaagaataagcccttcatgtccctgtttgggcaacagcgttccttggggggaggggggaggggggagggatggcattgggagatatacctaatgctaaatgacgagttggtgggtgcagcacaccaacatggcacatgtgtacatatgtaacaaacctgcacattgtgcacatgtaccctaaaacttaaagtataataataaaataaaataaaaaaaagaaagaaagaaattgtctcctaaccaaaaaaaaaaaaagaaaagaaaagaaaagaataagccgggcgtggtggctcatacctgtaatcccaacactttgggaggcccaggtgggtggattacctgaggtcaggagttcgagaccagcctgaccaacatggtgaaaccccatctctactaaaaacaccataattaggccaggcgcagtggctcacacctgtaatcccagcactttgagaggcagaggtgggaggatcacaaggtcaggagttcaagaccagcctggccaacatagcaaaaccctgtctctactaaaaatacaaaaattagctgggcatggtggcacatgcctgtagtctcagctactgtggaggctgaggcaggagaatcacttgaacctgggaggtggaggctgcagtaagccaagattgcaccactgccctccagcctgggtaacagagcgatactctgtctcagaaaacacacacacacacacacacacacacacatatacacacacacaaatttgttgggcgtggtggcgcactcctataatcccagctacttgggaggcttaggcatgagaatcgctttaacttgggaggcggaggttgcagttaactgagattgcaccactgcactccagcctggcaacagagcaaaactccatctctaaatagatatagatagatagatagatagatagatagatagatagatagatagataatagatagatagatagatagatagatagatagatagatagataggaagaaataagtaaaaataacaaccaaacaacaaaacagtggagtttatccaaagaaacagagactcttagaactgagaaaaggggccctgtttggctctagagacccacaccctgctctcggagtcaccgtccccttcccaaaggctactgagagagtccaagcgaagcttacatgtggggaaactgagtctcagaggggtgaaggtattgctcaggtccacttgcccagttttcagggcccatgtcccatgccctgccccgctcacctcccaatctccaagcactgcttggcatccgcggccacggcagccctggtgtacacatggttgtcaggttccttggaggccgagggcagccagagacagaggccgacaatgaccagcaccaggaccacggccagcaggcccagcaccactaacttcttcttcatggctctgctgcacccacggggtaaggagcagggtcaggcccagcctcagacatgccctggcccctccccaacagggcacagtctaaagtcaggcctcagaaacacaaggcctgtgtctccttcccgcttcccagaatacgtgcaggctgtccggcccccagacctttgcgcaggccatgccctctgccagaagctctgggcctcatctctgccctcccaaatcctccctgcttatcttcagagcccatcctggtaagaaccccatctccagcagcggcccttcctgggagcccccagatttccacacccctctttctgcagggcctggcctacctcctcacagtggctgagcctccactgcttagggagaagctccagcagggatgggcctggcctggtttctcctgtgtcccccaccccagcctagagcctggcactgtccaggagtcctctgaagaccctccaccccacctggagcatggggtttagcttccatagtgcccacaatcagagcgccccacagattcactgccacggggccaggacttaccgtccagcagcagacgggggccccaagccttgcctggggtgttggccacgaaagacaggaggatttggtggaaacagctgaggaaataaccggggtctccctcacactctgctgaagcctgtagccacagaatcttcttcagagactctctgatcaggcagccttctcgttctcctgaaggtcaagggaggttacctgaagcacgcacagcccagacctttctgggggactccgtgttacctccctctgcctctagctggtttctctgtctccagttgaactctggaggcaaagaggctgtcagtaacacatttgtttccatgaattctctcagcatgtctcccaggcacagggttttgcacggagcagggcaggtaggggacagggcattcctgcacaagcccaggatgtgcatgcggtaagcatggcaaagggggctcagggggcaccgccagcctgccctgctctgacgctggacttgccactcacctgctgtggggcctcaggcaaatcactgaactgtccagcctggatgacggcagcacctcacttgccttgctgctgggagtgttgtgaatagagtaggttagactgtgggcagggcttggtgaatggtagctgtgattatcatcatggctgcactggggacacccccaggaggcctgagtggcacaggtctcttgctcactgtatgtcccctgtggactcccttccaggctgtgcagtgagtggcagcagtgacccttgggaagtctcatggctacggcagcaggtgacaggtgtgacaacagggaagagggatgtggtgacagaggttggggttcccctctcccacagtcagtttcccacaaagggcggtgtctgccagcaagcccctccaatgagccccaagcttggtttccctccactccacgctgtcccagtgcagagcgtctgacctcagaggcagacacactgtcccagaggtggtctatgaatggagtccccgtgccctccccacacacagggaacatccaaatgccatcatggaagggtggccacctccccaggcttggtgggcctggggccgatagtgtgatacatttgaccccctcccagccctggatgcagacaccaagagcagagagacctggcagtagtcatgcagcagcgcaccaccccacatcctcagcacaatccaaagcagcccctcatccccaccgtgaccaccacagcctgaatccaggcgccacctgtttctgacctgaactccctcacagcccccgcctgcactccctccctccaacatcacctgcccttcagtcttccagaaagcagctagagggctctgtctgtccaactgcagaacaggccctgcctcctccctgccccgttggacagctcacacccttcaccaggcctgacagcgctcttgccactccaacaccctgggtcccagctgggagtccgggtcagggttaagggttcctgatagagacaccgattcctggaggtccaaagagcctcaggagctgggccagcaatatgcagcatctattatggacacagaacattcccatcacatggccgggtgcagtggctcacgcctataatcccagcactttggaaggcagaggcaggtggatcacctgaggtgaagagttcgagaccagtctggccaacatggtgaaacccccatctccactaaaaatacaaaaaattagccaggcatggtggcaggtgcctgtaatcccagctactcaggagctgaggcaggagaattgcttgaacccgggaggtggaggttgcagtgaggcaagattgcaccactgcactccagcctgggccacaagagtgaaactccgtcacacacacacacacacacacacaagaaaaaaaaggtctcctgctgggacacagactagttagagaaaggaaaaataaacaaatgatagtatgtgtattaataaaagaactagcaacacccactgcttagttgtgataataaaaactggacattaatataggcagaaaaacagaacagccttgatatggttaaccctttgacactggcaaacactgtgaccagtgctgcccacactggaagctcctgcatccctcttcctcatgtttccttcagcattaaggagcaacaagggagacagccagttcatagttccttacgcatggagccaaaggaccttcaatgtacaaggtctgagcaaggacccgcagccacatgtgcttcctgcttcagcagtgccccgtgggtctcagagctacccaaaggcctatccttccgagaggtttctcctctctcccaactgatgtcatacgtctcatcttccttgtcattcagatcatcaaccacaaacgtccttgccttatattttcatatcccttttcaccagttacagggttagttaacttacgaaattcttaacatctgcattagatctttttaaagtttcaccctcaaccacctattatttagaagtgaacacagaaatttagtttccttgtgctatctgttgacccctaaaatatgctgggagttttgggattttttttaaagtcaaatgcatggcataaagcaaaattacactactaaagaactgagtcaggccagacgctggcaacgtgaagacagcttctccttacccactaggttcatctttgcactgttaactcccaaagtattgcttctcggtgctgggtgtgtggcattcatattccccggcatcccgggcctgaagatctgtgatgtgcaatagggttgggttcccctggactctttctatgaagatcttccctccgcggacgcgctgggtgtagatggcataggggaaggaagagtccatggtgctgacgatctgcacctctcgctctggcgacgaaggcaggtaaatggaccactggaaattctgttcagaaggtccctggtagccactcacattgcaccagatagtgatgtgggagccctccgtgcggtacaagggtccttcctgaacggtgacctgccgctgtgctgacaccacacctacgagggagagaaacacacgcaacatgctcacttacttctcagaccaaaatgcaaagtaggcagcaatctccaaagggtttgttatttgtgtgacatgataataatataaacagcttactggccctttcaaaggcactctgtgatttataaatattaattaaaacactctgtggtaaagcactgtccctaatttgcatatatatgggaatttgatcatgccaagatgtgcttttgttacttattcaacagctgacccttgggaatttcatttagcccctctgtttgtcatgtatacggcagttttatatctatttattaatgctgtgtataaagtttttaataaaataagcaggaaaagttgaatccttggcacaaattcagatgaaaacaaataaaagcaaccatctaggaatctggctgaaattaaatgcttcttccttggtccgagtgctggtgggagggagtcctgggagcacctttttactggtgctgcacccttcattttcccatgtagctgctccccaacaccaccccaaggagcattccttagtttctcttccctccataaatggaggcagggctgagctcctgcaggctgctatcgttttaagctgagcacacccaaatacaaatgtgaagggctgaaacagatccctgatgcccagattcccacaaactgacaaaggggggaactaacagtgcccagctaaacctgtgacaaggacagtcaggctacccttgagtttcccactcaagactcccccgctgacctcctgccttctggctcagatactgttctccacggtcacttctgcctgccttctccatgttcttcttaaagtggcatggtgagtttaatttctcatttcgtgccaactcaacattgattgtgcctgagccactcagaaggtgggagggggcacacccctgcctcttcatttcggcagtggtcacgtactgcaggttgtgaaaagcgcaggtgagttataggtgcagctttgccaccaattagagctggttgtgtcatctcagacaacttgcttttcttctccagaccttgatcttctcatctatcacatgatttctaagaacgctttagagagcactagcatgggttccgatgctggctttgtcacttattaactgtgatcttggataagctgcttaacctctctaagcctcagttttctcatcggtaagatggggataataatgcctgtctcatagggttattgagaagatttagtaacatctgtaaagaccctagcacagagcctagcccacaatcagtcctcaataaagagctgctggctaagacatatttctgctggaacattctgtggctctggatccatagaggacaggatttggccaatgactgcttaaggacatttcaacggccccttgacaatgacaccatcactgggctgcccacctcatcccacagctgcagcccattcttgtgatagcttcccttttcccccacaaatgggaatggcggctgccctggctatgcctatctgaagtggatccagctggtgaacagccgggacagctcaaatactagtggagtgcagctctctgcccagcccagcaggtgactgtgcctcagtgtaagctaatctaatctgcaagatgacagacctcaaaacggcccatacaatgaaatgcccatggcttgcaaaactttaattcatgcagaacctttcctcacaaacaaaatcttacacagcaccccatcttggcttcagcagaaccaggaaaaataaaaaattggcaggggaaggaaataaacagaacaagtggtatctgaatttatttgatatattctggttgatggcattaattatgacatttaaagtcaccatgaggacaactcattagtaacatcagtatgttaaaatatggtgcataacatttttaatatatgtacagtcatgcactgaataacatttcagtcaatgaggaaacacatgtgcaacagtgatcctgtaagattataatggagcatatatagagatctaatatatggcacttaatgttggcatggcagatcaagtaggggaaatgactgatatttagtaacagtgctgggacatttgattttccataataaaatatataaatgaaaatatatatcccatctaggtttgttgaaatacaccctatgatgttcacacaagaatgaaattgcctaatgatgcatttcttaaaacatgtccccatcattaagtgacccatgactgtatacacacacacatatggtgacacttaaatcaaatgattgcagtattcctgaaacacagaacattttgcaaacaatttacctacattcataacattaggcatccttagaattgcagtgttctatgacagagcaactacaaccaacccccatccatctcctgcaaagaaggctggaggcaggtcagggtacaccagcatcttcaagaactgcttctcaatcctggacctacactggaatcacctggggagctttaaaaaaaataacagtgcctggaccccacctgacataactggtcttaggattaattagggttttttttgaagctccacagatgattcaaatcaggtgtagcaaagcactgttactttaaagtgtctctacctacgtggtgccagccaagtgctcaaatgaaatatcttaaggctctcactggctttaagtttctctctttggtagagacccaatcactggttcaaggaagtttcattctcctccagtcttccccagtgcaaaagaaaacagctgagacccatcagatactggcttttgtgatgcaataatgagtttaaccagaatgcatccgatttacagaccttacaaaggcactaggccagcggatcatgcacgtcctccccacccaaaggtaaacagtgttaagtggcctgaatgagccaggacagcagggtcaaatcaacttgtctaggctggaagcaggttataaacaatctggacaaataaataactactggattgcactttaaccacacacattcagctgcacctgtttattaaatacctccttattttccctctgccccacaaagggcttctgacccctgaaaataatgcttctcaacataaaaagaattgttttcttcttggcagtttaattccccttccacacatcccaccccaccatttccctataatggtaataccccgctgtgcagacctctgctgcctccaaagagacacaggcgcccaaccctgaccagggcatcctctgacccacagcccctctatctcccctctcagcctacaatagaaagttcctcccaggcaaggatcattttttttaaataacttttttaactttagacattctgtactctttggattactctgcaataagcaaatatgacttctgtaacataaaaagaaagatcaaaatgttatatataactgcatgaaaagaactagaaagaaaatactaggtgacaggatggcaagtgatttttatttttttcttaatattttactccttcccccagtcctctgcaatgagtatgtaccagttttataactagaaaaaaattttagccaaaaagaaaaataatgcatgtttgctatataaaattcactactgtagtatttatatatatatatatatatatatatatatatatacacatacatatttggtctttgtccccagttcctggcactgagctcctaaaccccttggaacttcctaagcaatgggagtaccttttgttatttataagaagccccttttggccatcccagagtttatgctaacgaggtgactgaaggtgagcacggaggcagtttcaaggaaggagctggccacgcttagaattgtggagttttcagccccgcccttagacctccaaggacaagagggggaccgcagattgatccaatcagcattggtcagtgatttgatcagtcatacccacgtaatgaaatcccatatgaaaaccctaaataatggagttaggagagcttctgggtgctggaagcggcgtgcaccaggagagggcatgggcagtgagcactactcccctctcagaccttgccctatgcactaaataggactgacctatgtgaccaataggaaatgcacaaatggtggaatgtgacttccagggctaggtcataaaaagacaagcacgatgttatgaggacatcaaagcagccatatggggaggaccccatgaggcctcctgccagcagctagcactaacttggctagcatgtgactggaagtagattctccagcctcagtcaactcagtcaagccttcagataatgtcaaccccaggcatctttttgttgttgttgagacagggtctcactctgtcacccaggctggagtgcagtggtgcaatcatagctcactgaagccttgacctctgaggctcaagtgaccctcccacatcagcctcctgagtatctgggaccaccagcacacaccaccatgcctggataacttttttatttcttatagagatgggatgatatggttggggtctgtgtacccacctaaatctcacgttcaattataatccccaatgttagaggtggggcctggtgggaggtgactggatcacaggaatggatctttcatgaatgatttagcatcacccttttggtgctgtgctcgttagagttctcccagtatctaattgtttaaaagtgtgtggcacctcccccctctctctcttgctcctgctttggccatgtaaggcgtgcctgcttccccttcaccttccaccatgattgaaagtttcctgtgcttgccccagaagctgagcagatgccagcattaagctccctgaacagcctgtggaactgcgagacaattaaacctcttttctttataaattctccagtctcatgtatttatagcaatgtgagaactgactaatacatagggtctcactgtgttgcccaggctggtctcaaactcctgggctcaagtaatcctcctggctttgcttcccagagtgtagagattacaggcatgagccactgaacctgcccctttccccccaacaacatcttgattgcaacctcctaagagactccgagtcagaagtatccagttaagatgttactgactttctgaaccacagaaactgtgagataataaacatctattgttcctttaagccttaagtttggggcttttttttttacaccaatatataactaatgtagacacctgcagtccctaagattgaatgcaaaattgtgttacatacacatgagtgtgttcttctgggaaaagagtccataaacttcaaaagattctcaaaggaatccaagacccaaaaagattaagaaacattgcatcagacaataaattgtcaatgagcaaggtcctgtccttttagattgggttttgaaatcacccatcccacaaatatatgataccatttaactagtttttcaagatattccttgttcaaagatgctcccactttttctttgtgctcaagtcctagataaacttggctaggggcaggaggtatgattcaggagttagtgagccgggagggctcactgtgcctgggaaagccagcttctcatgaatttttggaatatgccttggctcagaaacctacctctctaggcacaggatccaacttatatgttcaagatgtgtgactgagcatgtgaaagtgtcagagggatcgacctcaccattttacatctacttttccagttgtggcccctacaatcatcaaggctcattcggcaccatgctcctccaaattctgcatgcgactcagccacactaatatctttcttcatctataagatgaaagtaatacaatgcaccatgtagcaaactcacaggagaccctagagatcaaataacactgtgaaagccaccaaatgaatattttaaaattttatctcatttctgccaaggtgagatatcaatctaaaaacaggataaatctttgtaagtacaagaacattaaaaagaacattaagtttgggttaaaaatgcaaaactgcatatgcaggaaaattacgttaaaaaaaaaaaaaaatcctacacctacaaaaacaaccaaacaaaacattgatgatactgggctgattcactgaatggtgagaatatgagtgattttctcctctcctatttttctcaataccttttctctattatctccttttttaaataagcaagtatatattgttctaaaccgaagataaatgatcatgagcagcactttcccaggcactgtcctagttgctctgcatacatcatcgcatttaatcctcacaacagtgaatggggtcgatttcattacagccacatttaccagacaaggaaatggttttcaaggttaagtaaccttctcatgacacagaatgtgactaagagttttcttattccatggctcacactaaatgtgctctgtgaatatcagtgagaagtaataaagcactgactggattttcttggtcaccgggtcctaaaagaaatgatggggaatctatgcagtcccaagttaaaaatgggaactgaactgagctgccacagcatgctgaataggtggagtccaggccaactaagtgcttcatggaacttaaaggctccagagggaaagcaatcgggaaggcacttccacaggcacatcggtgacaacttctggggattcttacctgtcagccttcagccaaggaaggacaggaagtggcatgggctaaaagatcctttgtttgacctctttccagatcaggtgacaggaaaacacaacacttgaacctttccaataaggacagccagcacttactgagccccagccaggtaactgacactgttccaagtactctgcttgtataaccagctttaaccttgcaacagccctctgaggtaaatactcctagtgacctcactttacggatgcagaacctgaggcaaggagttagggagtaaatgaagctggctaaaggcacttgcactggccaggcacagtggctcatgcctgtaatcccagcacttccagatggatcacttgaggttaggggttcgagaccagcctggccaacatggtgaatccccagctctactaaaaatacaaaaattagccgggtgtgatggcacacgcctgtaatcccagctactcaggaggctgaggcaggagaattgcttgaacctgggagatggaggttgcagcaagccgagatcacaccactgcactccagcccactcggtcaatgtcactgccatcaagggacagtctaaccaaggtccagatggcacaagtggagccataaaaccaggacagcttgaggttcagcttcctgagcccacaggtgcaaggaccttatctggatccatactttcatcaaaaatgtcccttgaggccaggcacagtggctcatgcctataatcccagcactttgggagggcgaggcaggtggatcacctgaggtcaggagttcgagaccagcctggccaatatggtgaaaccctgtccctactgaaaatacaaaaatttagcccagcatggtgatgtgcgcctgtaatcccagctactccggaggctgaggcaggagaatcgcttgaacccagcaggtggaggttgcagtgagccgagatcatgtcattgcactgtgggctgggcaacagagcaagactctatctaaaaaaaaaaaaaggtaccttcaggattcctcgagcctgggaggccaaggctgccatgaacaatgattgtgccactgcactccagcctgggtgacagagcgagatcttgtctcaaaaaaaaaaaaaaaaaaaaaaaaaaatggctcttgaaacagccatcaactcccatgtgataaatgcactgccacaatccagcagcaaacctaaagttcggagtgaattcctaagtcttcgccttcactgacttcccacagcatgggcagtagctgtgagaccttgggctggttacttaacctctctgcacctcagtttcctcatctgtaaagtggtataatcgtcacagtgttatggaaggatttaatgagttgctacatttaaaacttaattcctggcacacaataagtgctcaataaatgtttagccgctagttgcagtagtagcaatagtagtgatattaactctagctgtggaactaatttctcccacacaccgtggcaggttgtattctccagacacagcagtaacaatatctccttcccacacgctcttttgcaatgtgaccatgccacacactcccatcaagaggtggagtttagaataattccctcctctgtggatctgggcaggaagtcactgtgtgacttccagtcctaggtcatgaaaagtgatgtagcttccatttcactcagggtcccctgaaccaccacataagaaagccaacggtcctgaggccatgctgtgagggggcccaaggcacatggagaggccctgggcaggtgctccagtccagagctggctccagccaggtccccctgccaccaagtgagtgaatgagccaatcaccacccagctccacctgccaccatgtgagtgaacaagcctcccctgtgagctgcccccagcctcggaacttccagccatgcctgccgtgcctgtaaattctcaacccccagattctgtgagcataacaaaattgttgttttaagccactgaggttgggaaacatttgttacatagaaaggtaacaagaacatatgctatggcttcaatcaacatttttttcagtacctattatgatggacactaggacagaaactgagggagagattaataagacatagttgacaagttgtcctaagctgacaatcctaaaataaatacacataactaatcattttaatggtatacgatagcagtgaggtgcaaagtgcaaggttaagccctttcagaaagtgaaagcattcaaaaagccttcaaaaaagtagtgacatctgaattgggtcccaaagcgcaagggaaatatataccacatgaaaacaccgcagtgcattccaggattagcaagaagtttgcggaggtcgttttgtcacatgactggagggcacatcagtgccaggcggaaaagggcaccgaaaggcacattaataaagtcaaacacctcctctgggacaggggaagttgagaaagagcctaacagaggtaaggaagaagatggatcagatttacactttcgaattatcactctggtggcaggtgaaggacagagcagagggcaggactggaagcagacagaccaaattcacagtcaaatgcgacaagatgagggcctggcctagttttaaatccaaggacaaaaatatcattcattcactctttcattctttctcttatctgaatccccagtggtacctaaaatagagctggtctaaagatgatgattaatgaatgttaaattattgatactacttctaagaagatgtaactgccagctacagaaccagccaaaaggactgcaaacccagtaattcatttcatcccaacctgactgatctctctgatgtctgcactgctgtgtcactagactgcctgattgtcctaggttgagacatttacctactgagccccagggatgggtggctgcttctaagctgctgcctaattccctcattactaaatgttgacgctgcttccttagaggactgctaaaccataactcaaaaatgttttaaacatgctactatttacttagattagaatatttacttaaatgttttaaaaaatacagtattttaagtcttttatctcttctgactactaccactaaccctgcttcccctcatttttccagagattagcactactgtgatttaaggatagagctctccagacttaaaaaaaaaacaaaaaactgcttttatatctagatatatgtaaccactgaaaaatatacattatttttcagcattttttacataaacattatcatccctttcattgagttatgttcctcagttttcctcctcaaagtttttgagatcaaatatagttcccatttttcttctttatatagctgcacagtattccatcataggattacaccacattttatttattccaatattaatgaatatttaggttatttatagttttttttctataaccaacaagcccatgccttctactgcttatcctttccccacctgaatttgtacaatccccagcttctcttatccatgaccactgaaaccccagggaagaccttatcactttcaggatgtccatggctctttcaccctatgccatgcttggaaccaggaaagcccaaaagaccccacttcctgcccttctattctgctcctcctctcctatcgctcatttctttgcctctatcctccactcctcccagcaaaggtagggatagcacctgagtcctgccaccctctcacctgcattccccctcactctcatgcgaaggacagcacagaagcagcatcaaaaaagaaaggcagcgagggagccctgcagcctgccctaggccagccatgcccacagccacaggaatagacactgttttcagccccacctagattcaaggcagcatctaatagaaatgcttataagtaaatataagtgccagtatttgccttctattttctagaggggaaaaaaattaaaaggcaagatcagattacttgcctggaaatgttctccctgtaattactctgaccgctctttctttccctccggttttggagataatggaaataggctgagtgttgggcatttttttttttaaagagggcagcttcatggcaacactccctctgagaagtccagaggctcagtgaaccgcagcttagagtgagttccagtaaaaggaccatcacttgaaccagtaagtgcctcattccttctcacagcatacatttcacagcaattactgttgctattattttacgcttcatttctggacctaggatacctcagtttctccagactctcagtctggtccccaggttttcagtctgagagaaaggtgtctgctggatttcaaacagtccctctactggccgccaccaccaccctctcctaaagaggactggaataactcttccacagctcccgccacactcagcactgcctgcacctcctcctggagctggcagggccccagctgtgcacccctcaatgctctcacagcttcaggaagaggactgctaagcccagggccctgctgacaacatgccgggagcgcatctgcaggcagggtcagaatgtcagctaccaggcagcagagagatgcggggcaccaacagcaaaagcacttggggggctttttcaagtggcatcagaactagacctggatacaaaggggtggccctggcttcaggaagcccatgataagtcagtctgctgtgtccttcaacacagtgtccccaccttctgtctcccaacactaggccatggagacacaaaactagaaaatggggctgcctagctacgaatgcccaggctgtgaattggggtctccaaaggaacctcagagccgtgtcctactcagagcagctccttcagctcttcaccctggaaagcactccggtacaaaacaggaatattcctcttctcctgactctgcccaaggcactgctgtgaccctctcagcagtggaagcactagccaatgtgccatcctcttggacgatagctggataatcgcaataagcagagctccaacaactagctctagtgtgtggggagaagtggggaggatggagaaaggatacaaaaagacactgtgggatttcagggcaacccatgagtgaggatcacagcagagctatgccttgcaaggaccagaactggaaaacctttgtgacttagaccaccctcctcaggacagctcccgccactcttcagggacaaagttcctttactcagccatagtttctgtgctccaaatactcagcttacacatgcctgttgctgctgcactcaccactgtggttctcagtgcaaattccccagaaagcagtctgactggctgggagacctttttttttttaaccaggcccccaaagttgtagattttggggtcatttacaatatgcatttccccaacacactcagatctaggtggacttgaccagatgggcatctgtattccattacccagcatataaccactttgggcaacagggaatgtgaagggccccaaaccgttccccaccaagagtgtgggtggcaggcaccctgaaatatgtctagcacactcataaagcatgaacatctacacacaactaaaaataaatagtgagagccctgacactgcttctgggggttttcccaagcacctgttacgaatgataacaatggatggccgctccttctccctcagctttgactttcattgctggtggctcaggctcctgtgcttggctgtcatcggtgggtagccctggattggacattttccctattcaattcaaggaccatgttcttgagcataactatgaccaggcagtaggcagtgggccctgctctttctttccagggaggcacagataagccagcatcacagatgcaaaaaacagaaccgtggaggtagagactaattcttcagcagcccagagaagagaactgggaaacagggccctcgcagatacacaagaccaagctggagagttcagggacttccaaaagaaggtacaagaatgagcactataccatagtggggtgggtcacaaaagcaggaaaaggtccccaaacaaagaatccatcagtcagttacagcactctccccatgtggtgaaacagtacgcaaccatttaaaaactgcagagaacaatatttatgaacacctaaaaatgctgaaagcacactactaagtaaaaggggagaaaggctataaaaggatttgaaagtattttcgtaaagataaacacccacacacacccacacacctctatatatgtgtggaaaaaggactgggctagtatatttaaaaaacgctaaagggaggtcgggtaataagggattgttttttccttgcactttgtgttttctaagtattctatagtctgaatgaattagattcataattaggaccaacagtcataagcaatttctcagaccacctgcctcataaaacccaaaaaaagaagtcagagaggggtgaatattttggtacagatgaattcaggttgtgtaagtggagaggagggaggtggccaaggagcctgaagtgggggaggggggctgatggtgaaatagggaatgggtggagagagaaaatgattgcaaaattggctggagccagcctggtcaggtcaactttgcaggtgtgtgaagtgtcaaatggttaatcagttgccctctgtttgagctgcttaatgcacaagggcctggttgaacaggtttgacctcatttactttttcttaaagctgtttagccactttcctaaaaactcctattttctgagttattaaactttccattccatgttgatcccttccgagccctctaacgcatctcttctcttgcttcttccaactggatgccttcatgaggcattaacagatactgtgagccctgatgaaaatcatcctttcagggtacaaggaaggcacctgaatgacagatggttggaggaatcttgagaaagcagtttaggcattaacatgcaggctgtcgctgacttacacagagccaaggacgtgacatacagcatggggccatttctaaatccccactgaggacaagggtcctggagggaatgggatttggaacaagatttgggctttgaacattcgctacaggctctgacaaagcagtgatggttcaaaagcctctgccccctggtggcaagccctgcccagatgctgttaaggggctctccaggcacgccctcctaattaggggcaaaatcagagaagcctctttggaagaagacaaaaggcacaatgagatgcggtctcctgaagtagaggctttctctctggttatcacctgaaacaggaaataaggactgagtacctgctcaattccaggcactagccaaatctgcagcaaactagcatttccaaaggtgtcttcttactttaatctcacagccaccctgtgagggaagtgtacattccccatttcgctgatgagatgagcaaactgaggctcggagaaattgtcagtgggatacagagttggcatccaaacccacaatctctgactctaagcttctgtttcattcattccacaaatatatatggtgtctcctctttgctggacactgtactgggctgatgagctacaagacccaatctttacagtctaggaggcagagatagataagtaaacagaggcggcaaagcgtggcactgtgaaagatgcactgaggacaccgagctaggtgttccacaggcgtcaggaaaggcttcacacaagagaggttgcttgtgcccagttctaattaggatgagtaggtatttctgctagatcgtggtggggtggggaggacatcacataggacctcagcagagagcagctcgaatctatgcagagctgcacgaggagccggaggtccagagtactgcagcagtttgacattgatgggtggtagggtccatgaaagtagaggaagaccaagaggaagcagcagacaggggccaggccagggcagggatagggtgctctactaaagagcatgggctttgaactatgagcagtggagagccactgggggtgtaaataaggaaacagatattccaaatcctgccttgggaagattgttctggcaggagtgatgggaaaggggccctggcagaagattccttcatgctcctgcggtgatccaggtgagagctgctgaggaccccaaccaaatcagatcactggacctccactgggagtgaaagggggtggtctggccagagagatagtaaagagatgtagttaacaggcaagagaatgtggggatatccagggagctgtccacaattcgcaggtcttaggcaactgcttgggagaagttgatgaggtcatcactggacagagaatctattccctgggcccaaccaactctctagaccatcctgccatgtgcctctgagaagtgagcttccccagccaagcccacaggaggacatatggagcaaaggtcaacagtcactcagctgatggatggcaagcattcagatgggaggtgcctccacaggccatgataacccatggatccatttgagaaagatgccaaaaaacagttaattcaaggccactttaaaatacctggcattcaatcctcctcaatgtctccatcaactgtagaccctataactaccaaatgagctccactcgccacaaagctcaagacacagaaacggtcagagagcagagcctattcctgaaaagcaaaagactccaaacttccacaactcaaccagtgaagggctggggaagactgacaggttcactaagaaatgagaggaaggacaaacaaggtgttcaaattagaaaatgattccattaatgagggctctgatgatatagttgtggaggttatcagtttgccagagctgcagatttaaaatacttacatggtcatcgaaaccaaaaaatgctgaccatcccccaaaacctcccaccccacctagtgctgataacaggagttatcagttgccttttgtgtacagctagatgagatatggatctgtggggggaagaaggggtgggcgtgctagcatctctcagctagactgtcatcggatggtgacattccccaggactcaagcagcatctgagaagccactttcagtatgactatggaacagctaaccacacaacacagcatactgaatgaggagcctcgcaggctgagaagaaagcaaacccggaaggcaacaaatggatacgtgcatgctgaaggactcgtgtttaattcttcccggtaatcctttgtcaggcatatatttttgtctcctcaaacttaagaaagaaatccatgctctggaggggagaaagagaggctgtactcattaactcagagctgacctcgtctggcaggattaactcgccatacctgtccagcccacagaacctggcctggagcatggagggagaaccacagccaactccagaaaaataaaaggctgcagcgagaaacaagtggggccacagagagaaaggggttttgaaaaagttctaaatccccatggctagggacagtgacatcagtgtgtttaccaagtatttgatttacttgctcaggcaaaattccagaagagacactgggacctgtgtggagagtttcttcactgcagctatcctgccaagctcattgtaaagtgacgaattttgtggacacttacagagaaaaaatagcttcaaatgctatagaccaatgctgcacgctgcagagacacagtctttgggttctgtgagctgtatttgggcattacgcagagttcagctgccatctgtccctttgaaggccagctaagaagttggtcccagcctgggcatggtaccactgtcctacattccagccatttgggatatcctgggttcaagcattccctcccattgctggatcaagcacttcccacctcctgctctgggaaatcagatctcagtaggtcatcaaccatcccagaaagtccagcagagttggttttggtttgggggtgttttttgagttgggtggaagaagagaccttatataatcttttaactttttctctaaggctgaattccctataagcaaaattttaaaattttttttaaagaagaaaaacacccagacaatccttaaaatcccctttcagctccaagactgtgtaattctgtgataccagtattgaaagcccctgcatttccctaactatatattcccctatgccagggaaaggtgcatgtaagtgagagaacaaaaaatttcacaatcgtggggacctcttctttcggctttggagcccccttccctctgtctctgtacggggcagctttttccttctgtcttctcccttccttcttgtctactaaactctctgcgccttagaaccaaaaataaaaaataaaaattcaaaatcatgatcttaggggtgaaagaacactgagaaaccatagaaagcaaaaatgaaaagccaacatagaaaaagtctgacttgaattagaagcagcacttaaaattacaggttcagaaaaagcttgaacagaatccagggctgaggtcagccctgagtctgcaggctctgccctctcacaaaggtgagtagatgggtctggagagggctgttcatgctatggaagggcctctatgccatcgaggctaaaaccaaagcaggagcaaatcagccctgctagtgtgtacagtcggcatcaaagaggcaacaacggtagagaatattttctgaaagacacacatgaaaccagtaacggcgatggtctctggaagaattaggtcagaagcagacttaatttgcactgtgtacattctttggtatcctttttaattgaacgcatgtgaatgcattacctattcaaaaataaatgtgtaaaaacacgtgccacgacaaagcaaaatgaggagacagtataaaaaagacaaggataattttaaatttctcctaataaaacgctgtttaaaaatctaagaggaaaaaagggtaggctccagctagtggagagaacaactgaaaaacaagagccacgtgttcccatggtcctggccaaccccacttctttcccatcctcactcgttcacatctgccttggagcacccacagcaagcctggcttcatgcccagaacatcgcctggctttcctcctctctccctgcccacatctcctcagtcactcgctgcctcctctcttgcttctctcccagttctcagtttgcccatcaaatctcaggtggtactctccattctctgctatgagggagttcatttgttcatgcaatttccccaccggagacaaaatgtatttcccaaagttggcttgcaatgacatctcccatgcctgctctgcttacccatgactttgacactccttccatcgagagggcagaacctgtgtttcctctctctgaatctaggtgggctacagctctggtagaagtgacactctgtgaccttaaggctaggtcacaaaaagggaatgcagcttctgccagcaatcctgggacacacacttggagcccgagctgctgtgtaagccatctgcctgctctgagcccaccacactataaggaagcccaagctagcccacaggagagacgaggtgaagagaatgagatgccagtctccactgctccagctctctagtgtcccagccccagccactatctgactgcaaccccatgaaagactgagccagaaccacgagcccagcccttcctgatgttgacatacagacttcatgaaagagaataaactaatttttgctttaagccactatgatttgggatgatttgttatgcagcactggataactgcaacacctgcttctaaacagtagaatcccaaacgtctaggccccatctctaacttacttcatgttcctgttctcactgattttttgccactgagcttgaccaagcccttgagtcaccaattccagatatttgtttaaacaaattcactgtgactgtctacactatccattcctccaaaacaatccctgttatagttggccttccccagttctcttcctggcatagagtagtctgtgcccttctctcatttcttaatatgaccctcacccatggagtgttcctagattctgctcattcataatgcttcttcacccaccctaacctctccctcctgtagccacagatcatccacttttccaggcctctgcactggaggctgcatcagccacctcccagtacgtcatcctttccaatgccctacaacacggggcagaaaggactcttttttgctgcacatccaggctgtttaagaaaaggcttaaggcagcttaagcacaaagaatgtcatcttcaaacattgtaacggcatcttctttttgggacactgaagtattcccatgattccaagaatcaaatgaacagcatctggttatggggtctctggtctctgccaaggcaaactcataaagcatttcagagcccttcatctggaaaggccttttctccaccccacgcccagccaatgcccactcatactttaaggcccagctcatccgtcatctctgctagggaaccttcctcagtcagtgccttatgcaggcaaccattcctgccttgtgttgtgttgtgttgtgttgtgccttaagtcaaatccttaactcatctttgtgtgtccccttgcatttcagacagtaggtgcccaataaatgtttgtgggatgaatcaactggtaattctcctggaacaccctttcccagtacacctccactcgccagaacaactgtcttcctcacaggtgccagccatcaccccgaccacaccctctcaaaaggcctttgccagtcatcaaacaaagcctcttgtctcctgagagccgctccacaatcaccttcccaagaagaattccccataccgagtccaccattccttccctgatcaaagttgctttcacaggcatcttttcagctatccactcttcacggcttggttttcatgcactctgagttggccctatctcccctttttggcctcaagcacgtcaagaggaaggctggtgacagcctttcccgagctcaggacagttttcatgcaaactcgttcttccaggttcttatgcctggaagaactgctgctctccaatagcatgaagtagacaatgatgttcttagcatccagtcttaaaactagaaaaagtattggcactgctgaatccccagctcctagaacggtgtgtggcacctaaacagagctcaaaaatattaggtgaatggaggaaagaatgaacagtcatctggcccagacttggagaagctgtgatctgtctagcccttctacaccaggagcgaggcctgaaaagctgcatgactcacccaaggtcacgagcaagccagtgaagaggggctggaaccctgtcttttgcctcaaagcacagggccctccttctgtcccacccagctttctcaccacccaccccaccccttccacactccaaagacagcatctccgtgagaagcgttgggcagtgtccaggagtgtttttcttcctggctttaaaacaaattgtgacaaatggctccacagatctaccgggccgtggagctgagcagatgggactgcaattcacgctattaactcaaattctacttgactttctttcaaatcagggcattttatctagaaattataaaaaattgttgggggagtgcctttgtaaggaagtttgccagcacattcatttacaaatcgacttgctcctggccaccctcactgatcacggacttttactcacgctcccttactctctcccatcaaagagtccagcgcatggagagagtgatggaatcttgaggcccaccggtctaaccacccacctaagcttgactcccctgtgcctgtggacatcctgcgtgcagatgcacattcccactaatggcagccaggggaaagcactattcgaaagttcttctttactttgaactcaaattgggctcaggggtcctggatacaggacaaccccaatctcttatttattcaatggacaacaggtgagcacatactaggcctggacactgatgtaggtaggcactaaagcttcagagagatgcaaacgagcaatctttaccctgaaggagctcatgttctatgggttcatttcctttccctgtgtcttacaaacaggttccagtttgtttccgtccttcagagtgtactgcctagaactgcatgctattctccacaagtggcctgaccagcttgtggacaaggatgaagcaagcagaccaccttctttcagtgcagacaagatggctgtttagaggccacatcacgtggcagacacctgccaactaaaaccctccatccttcccacagcctccccctcctacactttgcagctggattcaaaaccttgcattcacccttgttccatcaacagggccaggccatcagtctgtctcatccggactgttttttatcttacttgccaacctacacacttgctgttccttcttgccttaaagtcatacagatgactttaggtgattcagatgagtgtgacctctactttcaccaaacacaatagtcaattcagaaaggtcaaggacagaaccctccagcatgctaacgcagccaaagaagtctgaaaacaatacttggccacactgttttcctgcttacggatgtgggctgctcttgtcctgcctgtaaatatatcggatcgctctccttcttgctggcatccacagtaactatactcaataaacacaccaactttgatgccaaatcctaggccatcccacacatcttaaaaataaaacaaaaatatgttattccagctaccctcactctttttgtggtttcctgcagtccaactagctacaaatctcaaagccaaagattgtagctccctctcttttgttctttcatcaagccaaggagtcctgctcctctctctctagtctctcctgtgtcagtgccacttgtcaactgcctaatccagccacgctgctcttcaatattaaaggtcttcagcatattttaaagttagtctcctactgccactcttttccctactcttgccagtccactcagtaaactactgccatacaggtctcccacagcagtttctcaccagataaacaatggccggagattccactttgccaatcacatcaagtccaaactccgtgtcttggtatccaaggcttctaaagtctggccccactccacctactcactctgacacccaccactccctccaaacattcccggtacgtcttactggattttgccatttcctccaagttgaccaggagtcattcacacctaaaggctatgcttacatcgttttccatctcttgtgttggtgagctaaaaacaagatggaaaagaaaaaagaagaggaagagagaaaaagagaaaaggaagaaatggggaaaacagcaataggaccagctaactcctacagcagagtcttgccaggccctcccctaattgctttatatgtgttacaatgtttaaccctcacaactacaacaggagttgggtaccattccatccccacctgcagatgagtgtggcaccccaagattaagtatctgcccagggtcacgtgaaaagtctgcatgcatgctgaaccattccagctgcaccactgcccaggaaaaaagtcacaggtaggaagacaagtatagaattaagaacaaggcaactaactgtaccaggtgctacagaagggtggtcagcctggaaaatcaggaggtgcattccttgggagattgccgcaatcagagtctgggagtatgcaggagcctggcaggcagcccagggacaggtgaggcacaggcactcattcccttccatgtgagaagtcagggcacgtgcaaagccaaggccagaggacaaaggtgagctcgccaatagggccaatactgggtctggctggaaggggagggtggacagagatgggtactaagaagtgaagatggacaggcaggaccaggtcttaaagggtttgtgtcttgctaaagatgggcccttaattccgtgacacatctattcaaccactcctcattatctacctaaattctactgtgcctttacaaagcccagttcaagtcctttttcctctcaggcctgtcctccctactcctgagcaaaccacaggtgtggagacaggtcccaaccacctgcagatgacagaaggaagctgcatctaggatcggtctacacagaggcaagaagggatcctcctcctctgccttctcctttcatgctgttcttaccttctctcaaaaagaaagaaaatacagtgtcattgcttcttccctaagcttgttaagtcaaagcaagtcaaagcatcagagcttcattacttggctttttctagctataagtgtctggaaaatatcaggagtcactggcctctaggaatccattaagttaaaggagctccatgatctactatcataagatgacaaagaaaatatgcactttctttgggaggccaagttgggcgaatcacttgaggtcaggagttcaagaccaatctggccaacatggtgaaaccccgtctctactgaaaacacaaaaattagctgggcttggtggcaggcacctgtaatcccagctactcaggagactgaggcaggagaatcgattgaacccttacccaggagacagaggttgcaatgagccgagatggcaccacggcactccagcctgagcaacagtgtgactccatctcaaaaaaaaaaaaaaaagaaagaaagaaaggaaggaagaaagaagaaaatatgcattttctcaggattaaataacaaaaaatgccaagtttcttagctccagtcaagaaaatgacatcatgtgacaacagcagccattgcaagtttatcagaagatgaacaattacagatttttcatttctgaataaggaaccatttacacagacacatgtataacaaatgtctgtgcacatcccggacttgtcaaatcttaacattttgccacacctggtttagtttttttatttttcctttcaagaaagaaagcattacaggctgtgcttcaatccctatttcaccccctttcaagccccactattccacccatcccagaaatgacaacatcccgaatttggtatttaccactcttgcacatttatttttatgcttttactacctatgtatgtagccataatatatagagtttttggatgctataaaactgtttaaaatggcatcacactgtatgcacccttttgcatctgttttaattgacaaaacatttttgagggtaatccttgttgacatatgtcactccagggcattcctttcaactgctttataccatggtccactgtctggataatcattatctatagcacaatgtattcattttcctactgataaatttttaagtggtttccaacttttcattgcaataaatattcttgtaaatcttcatccaagggtatcttcaaccacactaggcattgcccaaattgctctgcaacatcagtgcaccaatttacattgccaagatcagtgtttaagtgtttctattctttgatgtctttgtcaaccttggtactatttgactactacacttttcaccaatcagatataaggatgaaatggtgccttcttggtattctgaaaattaattttaaatgggaaaataaattactaataagtgcagcttaatcaacaagagttttcattaacatgtgggaatacaccaggtgttccttggattttcttgaaaattctacagggagggtacgggagtgacggtacagataagattggacatgagctgataattgttggaactaggtgatgagtgtatgagggttaattatcctgctctctccactttggtacatatttgaaatttttcacaatagaaattaaaagaagaacagggcgtggtggctcacgcctgtaattccagcactttggaaggccatggcagaggatcacttgaggtcaggaattaaagaccagctggtcaacatggggaaaccccacctctactaaaaatacaaaaattagctgggtatggtggtgtgtaatcccagctattgaggaggctgaggcacgagaatcgcttggacccaggaggcagaggttgcagtgagccaagatcgtgccattgcactctagcctgggcaacagggcaagcctctgtctcaaaaaaaaaaaaaaaaagaagaagaagaaagaaaacaaagaagaaagaaagaaagaaagaaaattaaaagaaggaaatgccataaagcatctgggcaaagaacatccaaagaagagcactgatcactgcagcagacagccgttcagaatgggcagagagcagagctggcaggaagagaggacaaaaggaagaccaggaagggaagccaggaaaagagattttgcattgtgttattatttcaatcagaagacttaggaacattatttaattatcaaatttgtgtgtctgatgatcctttacaacactgcagcatcaaataaagtgttatcagatttctttcttttttttttttttgagactgggtctgattctgtagcccaggctggagtgcaggggtataataatagctcactgcagcttcaaactcctgagtttgtttgtttgtttgtctgtttgtctgtttgtttgtttggagagacagcgtctcgaactcctgggctccagtgatcctcccacctcagcctcccaaagtgctgggattacaagcatgagccactgtgccccagcccaacatctgatttcaaaagtactattgatattataatcaccattaaaaatcactgaagtttttgtcacccaaagttttactttgaaatatagaacatttcatttttttcccacacacctcacatctgcttttgatttttaacatgtgcatgaattacctcttattagaaaaaaaaacacaaaattttttggtaaaagaattatcttaagtgggtattttttccctaagtctgaaatgacttagtaaggataagaggtcaaaccatatgctttgtagtgaaactgcaactatgatgaataacattagaattctggatgccttccagcagctggaacagggcagacctgaggcgggagtcctcatgcttaggggaaggggctcaggcactgggagtcggtcagggctcccaggatgtaaaagatacacatgaaagaaacaaacagtgggactcgggccagtgcaaaatttggcctggaactgagctaaaaactgtcatactggtgggaagaagcagattggttcaacagggtaaccaaatgtgaaaaagaaaagcctcacaagaattaaaattgatggttggaactgggcgctccgaggctgtgggccggtgtcctgccccgaagggtttggctgccagcaggtgcagcgctgccctgggataccagctcctgggatgcgctgtagtatcatcaatcaccggtgctgctcgctgggccttggaagcacacagtagtagcagatgtcagcagggggccaccagggccacctgccagtgagcccactgcttagctgagtcatggtcaagtttctctgcagattgttgcctgaaaatatttcaccacctggaacctccctgtcccacccatcttcacttgcaatactcactcccctcacctctgcccctaaagcaattattcattaaccacagggatccaccatccaggaacaaaagaggcttgaaagctctatctgtgcctgcacttcttggtccaaaaggcgcagggggatgggggagaggcaccggggtcatggtgcaggctcagctgttgagcctcattccccaaacacaatgtgacaggtatcaatagttctggagttgatcatttcacagaaaggaaactgctgtcaacctgcccaaggccacacagctagtcctggataaattgacttaaagaacccaggtctctgattcccaaatcagtgctcttacccctcccacgccacctctctcttctaaagatccacccaatggaactgccccagggctggtatcccagctacttctccattcatgccgcaggtcaatgattcagggcggacactcctcaagtgaccttcagaggccctgactcactcctccgacagtcctttgtgtctggactcccagccgctcctcagcagctctgtcctcttttgtacatttattactgtcagcctgaggctagcaggaggtctcaatgcctggtgatctgaggccagcctgtcccaggccctcccagtcccgtgaggtcctcctggggatgcaggcacagcgactgacaaggataaggagcagaagggcaggtggctttctgggtgtgagcttggccttctgccacacccatgctcagaaaggtgtttacgggcacgtcttgtgttgtcacaggtgtagaaagggctttgacacgcggcagatcctccaatccctgtgaaagagggatcattctttctattatacagtgaggacgctgaagtccagaaaggtcaggtgactgatgaaaggtcataaaattagcaggaatcagggaaagggcaggaaagcagagcttccagttgcaaggtcagaactcttcagcccagcaggcgagtttgccagccagtctgtgccctggtctctgccctccccaaacacgtgcaccaatttggaggggctgctcccagcacgcatgctgcaagataaacttcagtgctcagccctctcactgtgacaacaatcccttagaaaggggtccacgctgtccatctgggcccctacaccaaagaacacctaattatcagtggtcctcactcaggaaacatgcccacaaataaagacaaaagtaaacccaactacacattcctcaaaatcctcctctccatttcacagaaacaccacaacagagcagaactgcaacctgatagcatccctgtctggttttgactctttcaaaacatcagggacctcacaggaaagcaatgcagaaaactgcagtcatttggccgcttgttaaggagagccctgagcagcaagctccagaccggagatgcgcatataacagcagcagttccacacagccctgcacagcagcaattcagcctctggcagctgtgatgatgctgaggcagtgtccccactgccccagtggcttctgcatgcaggttcatttgggacaggacacctctaactccatctctggccaggagccagcatagtaggtgccatgaaagccaggaagtgaactgcacagaatggactgttccaatgtccatgggctgcaagtgggtcccacgtcacccacaggtgaatcttaattatgaaccaaggtgacggcagagaggatgggcagcaaaggagggtgtgtgtggtgatcagccatcagaggagacggccctgtgtgatgaaaggacctcctcaggaaacctccccaccagcaactggctccaaatggtcagactttccaagaaattcctgtgaaaaggacaggctcagggcatgtgaatgtgatagtcagcaattcgcacctcagcagccagtgacactatggtatagggaaaagaacctagattaggcatcaaaagtacccggtccccttcatacatggctggtggggaggtaggatggtgcagccactttggaaaacagtctggtagtttctttcaaagttaccaaatgacccagcaatcccactcctaagtatttacccaagagaaataaaacctgtgtccacacaaagacttgtacacatcctaatagctgtattcatagtagccccaaactggaaacaacccaaatgcccatcagtttgtgaagagatggacaaaatgtgctatatccataaaacggaaccctactcagcaataaaaaggtgtgaactagatacacacaagaacatggagggatctcaaaagcactgtgctgagcgagagaagccagattcaaagggctacacactgtaggatgccatgtgcatcacattctgtacagtgcaaaactgtagtggcaggattcaggtcccctgaggctggggtcctggaggcaggagaggggctggtagcaaggaggcacaagggaactttttggggacagaggagtggtccatatttgataggtggtggttgtgtggctgctcatgtttgtcaacaaagaattacatattttaaactggtgagttccgttgtatgcaagcaaattataccacaatgaagcaaatctttaaaacactaggttccttttctttatctagagctcaaagtagtggcccatgctggctatgacttggagaaatcacacaagcttactgggtctcaactgcttcatttgtacaggtggctgcataacactccccgggcaggggaactgtagggatgaaatcagcaaatgtgagtgaacacacagaggaagcaacacataggccttccccaaatacccacttctgttttctttcctcagtgtgagtaagtggctctaatgatccacaaaccttccaaccagccaagtcaaggaccagcaggaggactcaggaaagtactgaaatgctggggagaaccaggacagcggctgagcacagccagacagggagggcagcctggtggggccctgggagccatggacgcgactgcgctgggagtggggatgggagatagcaggagttggtgggtggggcacaaagtgggagccagggccaaattgctgctgatttgaccattttgcaaaaggccagcctggctgtggcctcaggcctctcatttcctctaccataatgaggggtcacggaagtgccttcccacaactgcagcatctccctccacatttgggctcaaatacagagtggggccggagacagaaaaagtctccgtgacacactgtgatttgtttctgcactgtgtgaacccttggctctgtgacacagaacacaggtttcagcagttcctgtcacttcccacaggcgaaacagacagagcattcttttgtccggcttctggtgaaacgccattatcgttatttttaggaggaagatggagaattggggtgggtccccacaaagaggatggattcaggagacttccaggaaccttaaacggcttggaaactaattgtgccagttctttttgatgtctaattttactctaaaatttcctctcagcacaatatattaatactgatcagccaagagaaggttaggttttggctcacaaatagtcaaggagagaatctccttcattcattgagaaggcagaagatggcgttaaagagtattcacaggtaactaagattgccagagggagaatcgagtgagttgtcagtggtgaaatacagaggaggtagagagagctacactgagacaacaaaggcagcttaagggaacaaagccagctaagggaacaaagccggggtccctcaggtctgtggccaccggctccagccaggacagcctggtagctgaagagcacgtccttgcccgttacatgcctgtgtttcaagtgatgctaacttgctaatgcagatatctccccaaaccctgcccctggctcaccacccagtgagcaatcactcactttccccaggacaccttcagggaggtactctgccagcaccgcacacttaaacagctactgcaggttcttctctcagacgcagcacggttcctgagatgacgtcagcgctgctcgctgaaagcaccaggcaaggaggcaaaacaaaggaaatcctaaagagcaggcgagagaacagtggaactggcagagagaggcactggtgcggatggagagggcagcaataaaaactgggggacacttagaggcaaaggtatggcaggtgacaaaaaagatgagctgaagctcaggagagacccaggcagcgatgcccaaatgaccggctgaggaatcacctcactgctgctgatgcccttgacagcaatgtctgaggctggcgtgagtgctccatgctcagagatacctagaacccagctacaatggccttatcagactgaaacaagaacaccaagatattccaagggaggtgacaatggggtccaaaggttgtgcatttatggatcacaactatgtgctgagtgtggcccaaatcccagctccatatggtcacaccatgtctacagccaatcagctgaccggggtggcaacccctggctctgctcaacaataatgacaaccatcatttactgagcacttactatgtgccagaccgatgctaagtgctttcctcagatgtttccatttaactcttagaatcaccctaatgagtatctcctattattttacagatgaggaaatgagagtttagaaaagtaacttgcaaaatcatactgctggctccataacaaatgttgattgaatgttgtctgggtggacagaggcaaggatgaccggaacgagacaaacaaacaaaaggctgactgacagaccattcgggtagcacttttcctgggattaagcttagaccttgtaggcctatcagccagaagcagtgtgtaaaataagagtggctgactgggcacggtggctcaagcctgtaatccaagcactttgggaggccaaggcgggaggatcacctgaggtcaggagttcaagaccagcctggccaacatgatgaaaccccgtctctactacaaatacaaaaattagccgggtgtgatggcacacgcctgtaatcctagttactcgggaggccgaggcaggagaatcgcttgaacccgggaggcagaggttgcgataagctgagattgggccactgcactccagcctgggcgacagagcaagactccctctgaaaaaaaaaaaaaaaaaaaaaaagagtggctacccaagaacgcaacagcagcagcaaacactgatctgatgacaccccagttttgcagaagaggaaggaaacataagaatgtcaactctccattcaacagagaaacagtgccaccactgtctttaaattttcaaacttatcaagaaaagctccagagaggccagtgccagcaatgccggctgtctcccaagtctgaagggttttcctctgggtattaggagttgaggtgtttggttagagaagaaacaggatgcacgggagatcacacacacagattaagaggtgcctctcaaatgcctttcccacgtttctaactctgctttttttaaagcacgatcagacccgccatctgcacttttacctgctgcctgacgaaaaccagatgccaaaggcctcccagcactcacggggccctttacccttaggaaaacaccgtgattcagccaggccagattgatgcaacattgtaacaaagcgtatgcaaagtgcctagctccggactgcttgcagaaaaggcacattttgactcttctgagagtgggaaagatttgaaagatgggatttgcaccttattcttattcaagtctggagatctggaacttcttcctgaagctccacgtttagccagataattgagacgctccacctggtcaccactggacaccagccacccaaacattctcctctgcaaggcacttggcattctggtgcctgtggagagagcagccttctcactagcacagctcatgaacaaggatccccttccctggacagccaagatgtaaacctgcccccagaaacactgagagtcctagaggtagaatgagtcggccagcaagctccagcccattgaatgcagacccctgagcaaatcaagtcaggagaaggtggacaactgtaccctgaagaccacataccacccagacccaacacaaatagctgtcagcactgccacccattacagcttcagatctcgcttctaccagcatttcccagctgagcaacaaccgtcaaagtctggtcctggaaggacagccctccccgtcttggcagccacactttctggccctagcccaaggctgctgtggcatgggaggaatcaatggaggaatacatggctcttccctggttccttcctctcccacttcattgactaacactagtcacatggccccaactgaactgtgagggaggctggaaaatctggagtatgtgcatgcctagtgagttgcctctaccacatcctcttaacccttggcctctcattcccaaagtctagccctattttcaaatgaattcaacgcctcattacttagatctttcctcattacctcaaagccatagtggcaaaaagcaaacagcatcttcctaaaatcttcctcttccatcttcctctcctagatatccatcttacccttctttgccagttaatttattacaatcttcctttgacagcttcactccctccccgcactgctatcaactcaaatgtgagttatttcagtagcttgagcttgtcactggccttttacttttttccccttccaaagaacctggtacccagctacttaatccttatccttcttcccaaggcccactttcattcctttctcccccattcatgagcctgcaatacttttcccgctgcataagtcacgtgtcaccatataaactcacaatttgaggtgctctagaatctgtccatggaattagtcaggacataatctccctgtttttcggcagtgccacatccatacctgtcttcacaggtttgctcatgccaccattcctttccccagaacgcccttctgctcctcccacacaaatcctaaccctccctcaggacccatttaaaatacaatctcctcactcaactctttcctaccaacttgctttcccctctcctttctgccttaccacaaagctaagctctgtctctgaataatgtgctttttgatgataatctgaatggtacaagaagaaatcctatttcatgctcctttgagggagtgtctaatataggttgccttcgactataagtaatagaaaattcccactcaactggcttcaacagtgaggacaaaatgtatggagattggacggttcagtcttcaggggcttggccctcagggtttttcccatctcttcccgtctgctggcctcaacaaacctgctttcctcattgcaacaagatggctgcttcacgtccgagaatctagtgaaagaagctgtcccttctgcatttccttttacaaggaaaaacatctttcccagcatctcccagcagacttctcatacctcagtggccaaaaccatgtctaaactacgggcctccaggatgggctcagctcaatcagcacataccctagagctggaggcagggtcacctttccttgagtggcgtgtgggagaggtgtggcatccaacccaactgggtcctgccagcaggaagagaaaacaagagccactgtaggtaaccaatcacgtctaccacaggcagggaccaataccacatatctgtgtttcccctcacttgccacccccatcctgtgctggcagatgaggatgctcaacaaatagctgtggaactacaaattatcctgtgggtgtgagaaaagagtgtgcattataatagggtggtacaattggacatgtgtgcacggaaaatggaaaaacagccatgaaatccaaacagatgcaaaaacgttcttaacacagaaggtttgggaagctctgatctaagccctagcctgggccctactcccagttccacagatagggagcaggccccaggccagagtgctgggcttctcccagcaggatccagctggggctttctcctcagttcaacccttgcctctgaggaccagtggtctacagtccagcccacaacccttcagacagaagttccaggcacaaaaaggaagctcacaataaggaacgcccatgcctagccataactgagcgcatcacagactcacacaaatctgtggaatgagtgcatgatctcatgagctctggtctggaaaagtaagtctccctacactaggacttaaagggaaggcttctttggctatgccaatatctttcctgccactttcttcttcaggccaaacagctcctatccctgccttccatcttagctttccagcatactcttcccaggttctttgggctactgacaagcactccagacccaaatacacatgctcccacctgaggctgggaaatgtaccaagaactgcatagaaaatatactggacaaaaggcactccagtctcacagatctccagtcccacagtctatatcaccagttttagctgtttgaagttttagaattccttttcaaaaccatagctagcatttctttggctagagaaaactgtgtgaaatgcagcctaccataggatcactgattacaacatgcattcaacattcaatacatattgactgagcaactattaggttgaactatgtgacattattgacattcgactgcttctgacctatcaaaatggcaataaagctcaacttaatatttactctatgccaggcagtaggctaaggaaggatttgggacaccatgacaaacaacacagaagtaacccctatcttaatggaacttaaaatctagttgattaaaccattacttacaaaagtacaatctaacttcaggattgtaattaattataaatgcatttatttgtttactgcctgacttctttgctagcctataaactacacaaagatgagggttatgtctcctccatttcacacactggcaaagcatatagcagaatacatcatatatttgttaaatgtattgattagtgttacaacagacaattgcatgtgctatggaagcgtttggcagagagatctaatctaatcttggaaggtgaggatcctggccatcactaacttggaatttctgatactgatgatataaggttgagttatgtcttcatgaaacaggtctctatacagcatataaacaactaccagcatgcacaggggttccgtagggactatttaaaatacttaagggaacaaacggttttcaagctcagtctagtatttcagaaattccatttacataaacaattggtgcactaattgcaaatcattcttatttctctcctaaagcaggatcccctaaggatctttattaggcattctattagcctagtttgagttacagtatttacttaaaagtaataacagtgaagttcttgaaaaatatttggtaattcagacattttactaattcaaactaatcttcctcattagtctacgttgttagaggtttaaccattgtattaagagaaagtatcaaaggcttcacttagagtaatagtcaccaaatttttttgcaagacaccttggtagcaggaacctgagctaacatcaggaggtaggtagaaatagaaaataaaggaatgacaatttgaagagcaactgcaatccaatttagtccaacagatgacacacatatgaagtcacattcaaattataagcagagcacaaaaatattttagatccttatcttttgattaacctggtatcattcagggaaaaatgtcagggaacaccactgaccagcagtcctctcttatctattttgcagatcttatctatttttctccctgagaaccagccctggacacaaactgcataaacatcaatgagcctagacagggtcttcatgtgtgtttggcctgccattgttctctgtaccagtacggagatttagtaacacactggtcacattcatggggcatcttgaactctcttgacatggtaaatgaacagcaggtcctgttcccatgccaaaagcaaacaaaaacctgtcaccagcaaggaagacacccagtctctccaaaggatgccaaagtccacatccagcctcctttgcagagcctcacaaatctctcggatgcaggcaggatgatcacgggctagggaagattatgctctgaatgtcttaagagattagttacttaaaatcctccacatgacttcagtcatccccgttgcagatcacagagtaaaaagcctacctgattaaagctgaatgcctatacatttgcaaaagggaaaatatgcagaagaaaacgagagtcagatactgatgggcatagcaccagctctaggacatcagaggtgttgaataaatgatgacaaggagacacacatagttctgatatattcaccataaataccacagtcctcaaggctctctcaattacttacttccccccaaatcagagactgaatctggccttatcttcaaatgaggcccagctctccccaaattccaaatatgggaaattacagctcctctgtggtagggggaagagtgggaaggcgaatgtttgtattgcataacgttttaattaaaacaaagatgacgtgcaccagagtctctttctcatctcctgttaggggcgttttccagtactacttccaccctttacccacccaggtcaccatggtctttttcttccctctaggacaattcacctttaaaataagaggattgggcaagaaatctacaaagatttttccaaaatgaactcaggcctagaggcatattagttctctatcttgttgctcccttctagaagtgcacagttcagagggatgcccagccacagaggtgccaaaacgcagagctggaaccaatcacctgctccaacagagacaaggtgaaagcactgggcagggtgctcagaatgtgctcttgcttctttgtaatgaaatatcagaagacagattgtaacattgttcagcaagctattttttgtactgaaacatcagaaggcattatgaaactgttcagcaaatcatctctaaacaatgtcataaagggttacctagtttggggtaagcccggaatgaatatctgcaccatcattcctcccgctaacaaacatgtccatctatgtgaagcataattcccaacacaccaccatctccaaaccaacaccaaaccactgccaaacaaagctgaagaggaaaaccagaaaggtctccgagaagtgctgcttgcagggagaagaatggccctgcacagaggctcctgagggcagcaggtgcctgctttggagccttggcaatttccaccaggcagaatttacaaccgtctgggacctgcagtctcagagggctcacggagaagggggaagctcttggctacccgggaggtcaccagtgactctgagcaaagtgcagatcaatgcctgcttagggttaaccccaggctgggagagggcatctggcaaggaacagacctggaagagcctgcccctctttgagctgctacagcagcttctgggaatttgtaagagccatactgatgagggtcccacaccctcccttgccagggcgccctcagggaggccacactgcaggaggcagagtatgaggtggggaagatggatcggccttatcctcaccaccccccatacgagtctcctctggtatggatggtgtctcctctctggtgggaagtatgtgatttctctatttctatttctcttttgttcgggcttcctagaaattcagagctaggtgtgaaattcccaattcccacagacaagcaacatccccagcagtaataaggacgttccacacacccaggacttgggatatttgtgtattttcaagaataaaagtttgccctttagcctcctcagagccccctcccttctcctcgctctccccttaccactgctattcatcatcttactcctacagataccccctcttcgtggtggcaccgggcactagtaactcatggctgtaaaggagagctgagaacaaaacaggaagaaaagaggttaagtaatggcaagaaaaaagatgtaccttaggaataaaaaagagttcccgaatgtcacagtgtatttaattaatgcttctatttattaaagattaaaaatacatatcaggtgacgacttaaaatgttagtcatgattttaactgtgaattctgtggcaccggagataacagaacaatgagtgcttgtagaaggcactcggttatttgttgaatgaacttcttgggaaagccttcttaggaaagtattagaagtagattctgctaaaacaggggctaccctcagaggtctcaggacaagggatagaaagtcaaacactgatgtttaagaagggatgcctatgacacatgaatcccacagccatctctccaaaagagcaactattttgactgcgcatgcgggaagatggcgggccgggcgacttgagatccgcgggtctccctgctccttttccgtctgcgtcgggagctcccgggcacgtgaggccgtgccgcgtttactggcgggagggacggcctagccgggcgacgcctcggaggaggccgcggaccccttaggtgctgggcccttggaaatcggcgcgtggggggcggtgctcgagctgagcgcgagagggcgggagagctcgtggggtgcgagaggagcaggacgcccggccgggcagcatgagtcagcagcggccggcgaggagattacccagtctcctcctgcacccgacggaggagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccgatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaaaggacagttctttgtggactctacccttcccttcaaggagtatgtcatatgtcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcactcttgtacagccaaaataatgtatatatggaaaatgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctatttctacctcattgggtaagtcatttaccactctgtgcctcagtttactctgtagtttaccattagactgtgagctccttgagggactttgtcataatcactgttacatcccagtgcctcacactatgcctggcccttaagaagtgctcaataaatgtctgaacaaaaaaaaaaaaaaaaaaaaaagagcaactattttcaaaatcaggtctaaagatgagccatccaagaaactgctcttgctcccagaggttttaaagaaagtcattcccatgaacgtgagaagtaacccaacactttgaaatgataatctttttacagcaataactgttgctgcagggcttgagaaaaaaagttctcttcctttgggttaaagtcttaaatgctgagcccgtagccagcaaccttaaagactactcgggtccagttcattctatctggaggagtcacttgggaattgaaaacacaggaaaactttttttctggtccatgaacaaacaagaacacttaactgaattagacacaaaactaagtatttatggttgtcatcttaacaggtttcaaacaggcttcattttaatttaacataatttcaaaattatagcaaaatagtcaataaaatacgaacgtgcttaatttgatgaatttatgtgttttttgaagaaaatatgcagaataaacaagtcaattattctcactaaatacattaaaatttaagggtaatatttttattatgacttgctctcctgatacagcaaaatttattgttatgtagttatggaaggaggctcactactccccaatgatttcacaaattacagcttcagccagctataaaataaccaaatcagttctgatatagccataaaattaagcctgaaaaaatagtgaagtaaatcatccctttaaaatcaagttgttgaacaatatgttctgcatgattccatttatgtcagaaaaaatatatttgtgtaagtatatacacagaaaagggtctggaagaatatataccaaactataaagaatctatatcaaagtcaataaggggcatagacaaggaggggaactttcacattttactttccacattctttttttttttttttgccggagtctcactctcttgcccaggctggagtgcagtggcgcaatcttggctcactgcaagctccgcctcccgggttcacaccattctcctgcctcagcctcccgagtagctgggactacaggcacccgccaccacgcccagctaatttttttatatttggggtttcactgtgttagccaggatggtctcaatctcctgaccttgtgatctgcccacctcagcctcccaaagtgctgggattacaggcgtgactttctacattcttgtaacagaattatagtcaccgttacctccatcaaaaaattaaaattcaaaaattaggccaggcacggtggctcacgcctgtaatcccagcactttgggagtctggagcagcagatcacctgaggtcaggagttggagagcagcctgactggccaacatggtgaaaccccatctctactaaaaatacaaaaattagccgggcgtggtggagggcacctgtaatcccagctacttgggaggctaaggcaggagaatcacttaaacccgggaggcggaggttgcagtgagccaagattgtgccactgcactccagcctgggtaacagagcgagactccatctcaaaaatgaatgaatgaattaattaattaaagcaaacaaatataagctaccacctgaagtagaaaccagtatctcttcaccttacatttacataatactttaccctaatgcattttatctgctgttctaaatcatgacttacttcaaatcaaatcttaagtgaaaatcaagatttccttttgggggcattatacaaaaaagactgtaaaatttcattctctgaaagtctttttaaaaagggatagattgtatctggctgggatagggtaggtgtgatcggacccggaggaaatgacggctgctcaactctgcatctcctttcctcaccctgctgaaaagtgccacctagcatggtcaatcaaggtcaccaatgcaaagcagtagtgggcaaacaccacccaggttatccaaagcagcacatggggttgggaaactgatgaccttggagatttcaaaatcacctaacaataaccccaccttccctaaccacagggctaagcaacctaatggatcgaacatatgtgtgctttggtcatccgcaacccagaccactagactaattttgctttagaactggactatatcaagtgtgaacgatcatacttgttatcatgtgggaaaaaaggtttaattactccctaattgtctgggaaacaaaagatttcaaaatacggagctcctgggggaaggagagttaataaaatgggtccttgagaagtgaagtgggaagcctgcctcatgccatggcaccagcgatgccacaggtgtacccagtgccctgccgagagcagagacggtgttctcagagttgctatcaaaaaggaggcagcagactgcattctgaagcatcagacaatgggtcacatgcgaaaacagaattaaatacacaaaaatagcaccaacttaaggcaagcctgggcaaactgcactacatcaaagaaagaacacacaactggtatcagatttttttttctgttttaataaagagaaggcctggacacctgaaagttgacgggaagcaggcatcactaatttctccgagttcacagttttgttagaatgtctttgctctgattatggttttatttatttatttttttgagatggagttttttttgttttgttttgtttgcttttgttgccctggctggagtgcagtggtgcaatctcggctcaccgcaaactccgcctcccaggttcaagagattctcctgcctcagcctcccaagtagctaggattacaggcacccactaccacgtctggcttctttgtgtttttagtagagatggggtttcaccatgttggtcaggctggttttgaactcttgacctcaagcgatccacccgcctcagccccccaaagtgctggaattacaggcatgagccaccacgcctggcctgattatgttttgatggatatacagaagctcttgctttggtacagaaacaggccccgctttgcttcgacctctgggccccccaccttcagaaatgtctggtgccattcctggctcctcctctcagtggtcttccagggtatccactcacagctttctgatgtcgcccacctgtctctagcccagatacccagtcctcatggcaagtgactgcagcaatttttacaaatctacacccttagggttcccatcccaggacgttcaggtttctccacccctttagaagtgcccagaatatcccctaccccacaattccaacaggacgtcactctcctcttacttaagaaaaatgcctaaaattccagcccttccaaaaggcctttctagattgaccactcaggagttactctggcctccccttcactcctgctagactgaaaacaaggacagacttgcctggcctctctccccgagtagacacctacccccagtgaacacatcctgtcagtgtcctcccgtctatttgcaaattgattgactgtttcattgctggccttggatgacctctcctagagggcagggacggtggtgttcggcaaagccttggtcgtctggataatgggaaatggggtcttctggtgaatttaattacagggttaggtggaaactttgcttcaactctcattattagaaagtctattgtaaagctttttaaaatacaactgaccactttccagcgagggtagagttaatatgccttaatctttgatttaggatcttgcagtgccccaggctcaccattctcttctgctactataattatagatgcggaagacatacagactgggctgacgactgcttggaagctaatttctagaataaacccttgctaccacatcttgtgatttttgcccttctgaaggtggagttccaaaataaaaacaaaatcccgcttaactgagggttccagttgagggaggtctgctgccatggtctttgttaagtgcctgccaccatggcccacaattagtcagttaataaagggttcttgatgagagaatttggcaacatgtgattttccacaaatataagcttgattttgatgcaaccactcatttctttgaaaaatcagggggcattcacacacaggtgttctagatttccttacagtaaaacctaccctttacaaggaatagctgtgttcactttgaagcagtaaagaagcaggtgtccactcatggcaaatgaggaactccctttttttttttttttttttgagacggggtctcactctttttttgtgtgtgtgagatgggggccacccaggctagagtgcagtagtgcaattacagctcactgtagcctcaaccttctgggctcaaccagttcttcccacctcaacttctgaagcagctgagactacaggtatgtaccaccatgcccaggtaatgcttttgatttttagtaagatgaggtcttgttatattgcccaggctggtctcaaactcctgagctcaagtgatcctcctgcctcagtggcatgagccactatgcccagccagaagctaaaaatattaatcaaggagtcataactaaggatgcactgcacacccgaagccagggaccacaagaggtcagcaactgggactgcttcctccagttcccaggctggggctcagcagcagtggcctgggctctggggacttactttaagccgaaatcccaaactcattatcattcaaaccaattttctgtgtccagcatcatcccacctaaactggtccttaaaaccactgacagtcatttctccaatctgtaaaaggcctgctgaggcctttgcattatcaggacttaactgggagtagaatgccctccccatccaaatcctgaccatttctgaacactcagcccatgtcctcttcctgagtgtcttccccaacaacaaccacctacgctgaactttactttgatctctgcagcaaactgtagatagagatgggatctcactatgttgcctagctggtcttgaactactgagctcaagtgatctccctgcttctgcctcccaaagtgctaggattacagcagtgagccaccacacctggcctatgtatgcctttttttttcttttctttttttttttttttgagacagagtcttgctctgtggcccagtccgcagtgcagtggtgcaatctcggctcatggcaacctccaggttcaaggcattttcctgcctcagccttccaaggagctgggattacaggcacgcaccatcacgcccagctaattggccaggctggtctcaaactcctgacctcaggtgatccacccaccttggcctcccaaagtgctgggattacaggtgtaagccaccacacccggccacgtgtgcattttaaaacgttatgctcagacggggtctataggtttcaccagactgccaaaaggatccatgacacaaaaaaagtactctcagttgcatccttcggaacctttcaacacatacacatatacctcactcatccttttgtgaagagtgtctattaatcactagattaagaggatttggataaaatttataaacgtacaaactttgctaccaaggactgacacatttacttttctagctcatcagtttatgtcctagaaaaattccagagccatattaaccagctgtttcctatttttcattttacgatggtgtttccactttcacctgcaaagtgactaatagtaatacctattacagtaatttaagtaacaccatttagagtaatttcatctttagtactgtatttatactactaagaaagccgccaacgattcaagctgcactcactggtgaaaccctatgctatatacgtaattaatttatttcctaaattcttacctccctccaccccctccattggaaaataaactctaagaatgcaaaagtttttgtgtgtttttcttcaacgcttagagcagtgcctggcacctaacagtcaatatctgctaactttgatgaatgaatggtatatttatattatgcaatattactatgcagccatgaaacacaatgagttagagtggtaccagctaatttaatggaatttccagaagtatgaaattaagaaaacaagaagaaaagtgtcaaaaatatcatcccactttttttttcttccctgaaacggagtcgtgctctgacacccaggctacagtatagtgctgccatcatggctcactgcaacctcaaccttctgggctcagggaatccttccacctcagcctcccatgtagctgggactacaggtgtgtgccacaacgcccagctaatttattttaaattattttttgtagagacagggtctccctatgttgcccaggctggtctcaaactactaggctcaagtgatcctcccacctcagcttcccaaagtgttgggattacaggtgtgagccactgtgcccagcctaatcccactttttaaaaagtatacccccaaatccatacactggtgaggaagtggagaacgtggaatcctcacacacagaatgtaaaatggtacagctctggagaacattttagcagtttctcaaaatgtttaacgtagctactacatgacccagcaattcaactcccagatatacacctgagagaactgaaaggatatgtccacacaaaaatttgcagaggaacttgtacacacttgttcacagtagcattattcataatagcccaaagtggcaaaaacacaaatgttcatcaactgatggacaaataaagcatgaacaactgatggacaaataaagtatatcattcagcatataagaaatgaagtgctaatacatgctacaacaggaatagaccttaataacattttgctaaatgaaaaaagccaaacaaaaggtcacatgttgtatgattccatttacataaaaatacctagactaggcaaatccgtagagacacaaagatcagtgactgcccagagccagagggagtggtgaatgtgaaatggctgctaatgagtacagacttctttttgaggtattgaacatgttatggaatcagatggtggtgatcaatgcataactttgtgaatataccaaaaaccacatgaaaggtacactttaaaagcctgaattttaaggtatgtgaattgtatctccataaacctgtgattttgttaatatacgcttatttgcaaacgaatacatggataatgaggaataatatgaaaggttaatgacaaccttggtgatagggtacaggagactgggagaggaagataagtgttgaggtagaagaagacaaaaaataaaaggctaaaacaataatccagggccagaggccatgagttgggagatggagcaagacgaagtgtacaaagaaatgagcataaatcataaaaatgagggaactagggttgaaaactccagcaagtagtttgtaatgggggagatgaagcaaacctaagtaactgcaatgattcaacggaatttgcagaaaatgcagaagggcgagaaaacaatgaaaaaatggatcagaagatttaaaattggctctaccccaccaaagttttaaaaagcaagcaagaagaaaattcagttgctcctgggcaagaattcttgggcccagtggggtagaaccaaaccatgataaggagacaccagtgttttgtaagcaagagaatatattaaggagagaaaaggggcatttattgggagaaaagttctcactgtgattgttctggactaaagtagccccatcggactgcctcaggaactcatggtggaagaggtgccactggaaaatggctaagtcgggatcttccccaagaacactagaagagacagaggaagaatagaagagctttaaattttagcagatatttctttttcttgtttaattaaaataaatcttattgacctaatatttttgagactgggctcttgcaatgctccccagactgaactcaaactcctaggctcaagagattcttccacttcagcctcctgaaaagctggcactacaggtgcacaccactgggcccagcataatggctatttcttgacaaatcttgacaatgccaccagtatgtttttctttagagacagagtctcgctttgtagcccaggctggagaacagtggtgtgatcctagctcactgcagcctcaaacacctggactcaggagatccccctgcctcagcctctcaagtagctgagactacaggtgcgcaccaccacacttggcgaattttattttattttttttattatactttaagttctagggtacatacacctggctaattataaaatgtttatctgtacagacaggttctcgttatgttgcccaggctggtctcgaactctcggcctcaagcaatcctctcctcctcaccttccaaagccccgaaatatgcccacatccagcctgccaccagtttctttgcatacttctttcctaggcttgaccaagacctttactttcttctgtgtacagctcagcattaaaaaaaaacaaaaaagtttaggctgggcacaatggctcacgcctgtaatcccaacacttagggtggccaaggtgggaggtttgcttgaacccaggagttccacaccagcctaggcaagatggcaagaccacgtctctccaaaacaatttttgtaaaattagccaggtgtgctggcgtgggcctgcagtctcagctagtgagaagactaaggcaagaggaacccttgaacccaggagttcaaggctacggtgagctgtgatcacctctccagcctgggtgatagggtgagacccagtctctgaaaacaattaaaaataaaaaaagttgaataatgagtcttctttttagaggcaatgtatttttcctctttaactttttgttttccttaggctatatgcacaatagacaaagttgaaatttaatcttaatctcgtaaacccttactgtccaaacacatcaaactcaaaaaaaaaaaaaagacaaaaacaaaaaaggtgaaaggtgtacaagagaaaaaagggaagtaatctgtgccaaatgtacattccttccacaatttgggacaaaaatgatgtctacctggtctctgggtgccaaaataagacattagagacactcccctccttcaagaaataaaattggaatcagacactaagatacaattaaacagactttgaaagttggtatgcactactgggaggtgtctcacagctggcagggtcaactgcaactagaagaaaagctcctaagggcagaaactaagtggctcacttcctctgtaacactgccgtgcccagcactgtaccagcaccccagcagagtcaacaactttccgtcaagccacacacttacggtctcatcgtccagtggaggccgcagatgagacatagtgtgccaaatcccaaatgcacagggtgccagacaagtctgcgggaggcaggaggactagggaagccttccaggcaaggtgatgcctgagctgagttgtttttcttttgagtttggaacattaatttaatcggaggaaaacaagggacatgaaaagggcaaggaaataagaaaatgagctgagttttgaaggcaatgatcggatgaagtgagagaagaatattccagcagagggagacaaggagactgcagagatttcaaggggccaagagctgttcggtgcagctcagtgaagcacctaaacagaggtgggggaaggagaacaggggtcaaagcccagtattgaagtgttctggataccaagctaaggagaccttattacgaaggtactggggctgctgaagggtttaaatgggagagtgattgtgaacagattaatagtttggaaagatacaggcagaagtaaacctctggatttaaccaaaaaataaaggacagaaccacaatgaagatgttggaaaagatcaggaaaaacactgttaaaagatattcactctcggggccgggcgctgtggctcacgccttaaatcccggcactttggtaggccgaggcgggctgatcacgaggtcaggagatcgagaccatcctggctaacacggtcaaaccccgtctctactaaaaatacaaaaaaaattagccgggtgtggtggcgggcgcctgtagtccgagctactccagaggctgaggcaggagaatggcgtgaacccggtaggcggagcttgcggtgagccgagatcaggccactggaatccagcctgggcgacagagggagactccgtctcaaaaaaaaaaaaaaaaaaaaagagtctggctctgttgcccagggctggagtgcagtggcgcgatctcggcgcatcgcaatcccttcccagcccccgggttcaagtgattctccagtctcagccgccggagtagctgggactacaggggcgtgccaccatgtctggctaaatttgtatttttactagagacggggtttcactatgttggccaggctggtctccaactcctgatctcgtgatccgtctgccccgacctcccaaagtgctaggattataggcataagccaccacgcccggcctcttttttttctttttcttttctttatctggagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgctcgcctctctccttccagtacctattgcatgaccccccacgtccgcctcccgccattgccagcaagcgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatagaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacgaccttcccacactttgtcctcacttgcaacagggacttctggtctgcctgccatttctaaagcacccagtatggatgtacagcaggagacacacaagtcccaagactgcctgggcctactggcccccttagcatctgctgcaggtgtcccctctacagctcccatgtctgggaagaagcacaaaccaccaggccccctgttctcctcctcagatccccttcctgccacctcttcccattcccaggactcagcccaggtcacctcgctgattcctgcccccttcccagctgcaagcatggatgtgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaacctcagttcctgaaacacagtgagtgaggacggacctcaggctgtctcttcgggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaagagtgcactgcaggttgaggacaaggccatttagtactgcagaccctcacggccttcccacactttgtcctcacttgcaacagaggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaagggcataaacccgggaggcagagcttgcagtgagctgagatcgcgccactgcactccagcctgggtgacagagcgagactccgtctcaaaaaaaaagaaaaagaaaaaaaagttattgtgacatttctgtatgaaatcagccttcactacatggataggaccagcacgcttctgcggcacaactctgcaatcatactacatttttttttttgtattttttttattccttttgagacagagtctcactctgtcacccaggctgaagtgcagccgagatctcggctcactgcaacctccacctcctgggttcaagcaattctcctgtctcagcctcccaagtagctgggactacaggcacacgtcaaaaggcctggctaatttttgtatttttagtagagatggagttttgccatattggtcaggctggtctcgaactcctgacctcaggtgatctacctgtcttagcctcccgaagtgctaggattacaggtgtatgtttatttatttatttaagatggaatcttgctctgtatttattaatttatttagttgagatggagtcttgctccatcacccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttaattatttagagacaaagtcttgctctgtcacccaggctggagtgcagtggcgccatctcagcttactgcagcctccgtctctgaggtttaagcgattctcatgcctcagcctcctgagtaactgggactacaggtactcaccaccatgcagggatatttttttctattgttttatagagacacggtttcaccatattggccaggctggtctcgaactcctgaccttaggtgatctgacagcctcgtcctctcaaagcactgggattacaggcatgagccgccaagcccggcctctcactacatttaagtgacaccatggctcatgcctgtaatcctagcactttgggaggccaaggcaggtggatcacctgatgtcaggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggggcatctcggcctcaatacctgcatgagcacagtcacgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgctccctgggcccatgccagtggcctggcctcggctcaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagaccccatgtctacaaaataataataaaacacacagctatagtccaagctacttggcaggctgaggcaggaaggtcccttgagtccgggaattggaggctgcattgagctataatcgcaccactgcactccagcttgggtgacaaagtgagaccctgtctctaaaagaaaaaaaaattggcctgtgagcatgggtttgattttcaaacaggacctggagggtagggacagacagtgctgtcacccttaggtgctgaacactcagaaacgggccagcggcagcccttccctcacctgcagacaccagattgggcagaacagcacatggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccatgggccctgtctctacccaggacgtccccacaccctcgcagtgtcagggaaatgatcatggtggcggtgacactccgcaggcagggctgctgagagaagctgagaagggtcacactgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcatgtgagccttgctctcctggggaggctcaggctgacagctgatgtgggcattgccgaaggtaacccgtggcccagtgtatatggccgggtctcctcaagctgcattcattcaagtaggacccagggtgcgtgcccatctccagcccagggcagctcccctgtaagctgggtgagctactgaagccaaggcgggaggcagctgacaacacccacagcccatgcggaggtggtggaaaggctgaactcagcagcaacaccaaatcctggaccaggcaaaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccacaccccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaagtgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaaggctggatttggcttttctaagcaacatgtgttcctgcgcagggctgaatggtcgctgagacagagatggaagccaggacaagggagcccaccgggcccagataggtacagagagcagaggctcctgttctgtcctcgccacccacgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgcgggctcagcaggagctgcccactgacacacaggggacacccactcctgccaccttgggagcggttgccagacagagccgcactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccatgttcatggggttatttcttgaaaatacttggcggcctccatgcttctgttttctttgagccaggtggtcaggagggcttacaaacaatgcctgggctcccccgcagctgtcggcagatggggtagcgaatggtcctgtgcctccacctgctccgggagggagtctcccgtctctaggcctagccccttcctaaccctccacgtatcctgttctccagagacttcagaacccactcctgagaacagcggagccaggcgcttagaggaagaccaaatgctgccaggacacggattgtccaggattacattccagcatcttattaggtatctggatctgttggggaaaaaattagaaactatgtataaaacttaaaaatattcaagcatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcatagcctgggattccctccctggaggtcctgtcccccgacatttcacgggccttctgagctgccttccaaggaggactaacacggcaacaaaagaaccatttctgcacaaaaatccttctgggaagaaaaagaagaaagccaagaatggagtcaaaacgctacccagtgctgactaagcctctcaaaccctgttctaggtggactgtggtttctaagtcagggaaatggaagaggccccacccacacagggacagggccatggcccccacaggatgaagcagcagcgtttattcaagatacaacagtgagggaatccggtcacgttcccttctccccagagagggcgcttcttgacaagtgattcagtagaaatcttttagactctataagttaagttcataaaaaccactgctttcaccctgtctcccagggccaggcctggactccgagatgaactggtttggggcgccctcgggtggccacataaaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcagagcggggctcacagctgctggtggggaggtctttggggcccaagctcccaagtccacctcaggtgctagaaacccctgctggtgtcatgaaccccttacagtgggacgggggtggggtggggtcctgacaaggcatgacttgttgggtgaggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctgggcaccccctatcactcccatccatgcaaacctaggcaagtccctgtctctgaatctcagccaccaccacatacaatgcaagtgggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggtacttctgggtctcagtggcccaggacaaggggccagctctgggctgatggggaggtcttcatgatgtgcttgggagggaagggggggcggtccaaatgcactgctggccacggccaaagctctgagctctttgttaaggccacagtgcagagggaggagggtggcaaagaggagaggcaggggcgggggtggcagtggtgctagtccttagaagcagtgagttactgcagacaggggtcaggggataggtccgtggtgctgggggtctggtgggagcagaggggcaccccacggcctggagacctggtgtcctgggcagccacaagagagctgggctacctttccaggcggtctagaaggaaaaggaaggtgagcaggttggcctccggcagggacgacaacaggttgagcatgcagctcttctttgcaactgggtctgaaagagctgcaggaggcagtgggtcactcccctgggttacgacaagccggagacctctcccgaggtggtcacatggagcgcccgggacacgagtccttgcgcagtttaggcttgtcatcatcgtcacacccacagcgctggccgccagtgaggaccctgtgaggggcacctgtgtggggtgtgaaccacctgaacgccttttctctgcctcgcaggggtcagcagcacccggcaaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaacccctcgttgtcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcaccgacacgtccttgttatctggaaagagcacggaaatgcagcggcctccttgaagatcctgagtgagtcacccaccatccctgccttggctaaagcaccgtccctgccatcctgaccactgtgtgggtccctcctgggctttgagcagctcatctgactcctcccaagagctgtgcatggttctgtgtctgcagagttgataggggtgcgtgggcattcccattcctctcccctgcttggcctgatgtgatggccaggaggaggccagcatggcaggacacagcgcctgcgtggggattgggtggctctgccctgtacatagcaaccacccctgcaccagtgtcatctgatagcaggaaggccgtgggagaatctgattggtttcagtgtttgaaccggtgtcttcctttggacccaattggccattggtgcttacatcctcaccacaggccaggttcattctgggccctcagagggagctgaaactaccacagggccctcccagggatgctgggcattctaggggtcctggtcagggtgggtggtctgtgctgcaaagaagggtctgcaggcacaaaatcctgttgctttgaagatgctgggaaggaccctctggggtctcagtgccctcccctggcatttgaggcaggtccgggtccttcaaagcctgtgagggttggtgagatggaggcggagaggctgcagccccggcctgcgctgaatttcatcagtgccctctgcccaccacatcctcatacagggcagtggacagaccgcactgagtcctgggcttccacctcctgtccaaccccaaggcaggaaggccaaggccccgcagaagcccctggtccactgcaccaagtggcacgagtgggtacgatggtgtaaaaactggcttctatagaagctgtttgtacaactcttgttttctcttttttaaaaataataaaacagtaaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaaatgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttatgtttaacttgccagagtagaaactcagtttctgggcgaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatggtggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaacaaaaaacatgtaatttagaaagtaactgccaggaaaaaaaaaaaaagagactgggccagtggcttactacacctgtaatcccagcacttggggaggctgaggcgggtgaatcacaaggtcaggagatcgagaccatcctggctaacacggtgaaaccccgtctctactaaaaatacaaaaaaaaaaaaaaaattagccgggcgtggtggtgggcgcctgtggtcccagctactggggaggttgagacaggagaatggcgtgaaccccgggacgtggagcttgcagtgagccgagatcatgccactgcactccagcctgggcaacagagcgagactccatctcaaaataaataaataaataaaatataaggtctcaggaacgtaaagattgacatttactcccaaactattaatatatgtccacccacctttcttgtagcaaaatcttaacttgacgtttgtttcaatagttattaaatttaattataatgtcctagcccaaaatacagtagaggtaaacatccaaggtactggcttgaggccactggccctgtatctataaaggagagggagaccatcaggggagggagggtaagaaagggaggaagagggcaaacaagttatcaaaaaacaacagtaggcagggcactatggctcatgcttgtaatcctagcattttgggaagccaaggtgggcaaattgcttgcactcaggagttcaagaccagcctggacaacatggcaaaaccccatctctacaaaaaatcggccaggcctggtggtgtacgcttgtaattccagctacttgggaggctgaggtaggaggatcacttgagcctggaaggcagaggttgcagtgagccgacatcatgccactgcacttcagcctgagtgacagagtaagaccctgtctcaaaaacaaacacatcagttattcatatttcagagtaaggacaaaacatttttaagtagctggcaaaggacatcactatatttcagagtaaaacaaataggaaatgcttatcatttgacatatttttaaacattgtatctgaaaagtgaacaaagaagtgaatgtgcttatgattaaattgactttgttactttgtaaacttgtagctttagacctgtctcttagcatcaccaagccttgatcttttcatctataaaatgggcatggtaatgccagccttgctatgtttataggtcacttaggaatgaggtatgtatggtgttgaccatggtttctggcaagtggcatatattcattataccatagctcttttcagaaagctaagtcaccacgtacatgttaatgcaacctgctgaaaataggcatggaaaaactagaaaatctagaaaaattagaaaatcactgaagaggattttctttaaaaaaatacatactttaaactcgggaggctgaggagggagaatcgtttgaacctgggaggcggaggttgcagtgagccaagattgtgccactgcactctagcctgggctacagggcaagactccattaaaaaaaaaaaaaaaaccagcaaaaaacaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacctagtgcttatcttcccaggccacctattttgttcctctccaaggtgatggatagatgaaggcctaatccagccgcctggaagtttgctgacgcttgtcctgtcacagattaatgaagcattgttttctgatgaagctttcatgccgctgtgctgatgtgtcttctcttctctctaggcaggaaactgcatatcttctggtttacatgaagatggagtgctaatggaaatgcccaaaaccttcagagattgacacgctgtcattttccatttccattcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtacttcagtattatacaactgctgtgaccagacttgtatactggccgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggattgtgctatagaaattcaaaggcaagggaagtcacttctgttgtggggccctgggaggagcctacaggctggaaagggttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggtgagaagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctggcggggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccagggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattctatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcatatgaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttcttcttctcactctgccactggctcctcatggaccaccagcctgggtgtcctcagacataccacacacttcactgtgggagtcacgcagccctcaatgctccttctccagggagccacggggctttcctcctcaggaggactctgcaagcagctggatgaagggccctcccgtctctcatccttccttaatttttgtcacagttctccttccttccactcagtgcagtgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacataaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagataactccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtacgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcaaactgtcaatttctcctccacccctgggcacacaccaggagaattctgtctccaggttggaggaagtgcctgtgagagagttgtgtctctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaataacacagcaccctcatagcccagagagacagttctaactattatgccaataaacccggaaaagaccaaatccaatatgacacatatttcctgtttcgttttgatttcatgccccctcccttaacctcccaagcagcatggataacccgaaggcccctgggaactctctccaattggatcttacgtggaaagcagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacatggttttatacttgcaaaatcatttgctctcaccagaccccaaatcctccttcgcaaaaggagcccagaatcaggtttctgtaccctagagatggcgctttttcctcaggaagtgagttatttcagggtacgtatcattctccagtgtcaatggctcctgcaattatagaaaagaaaacattaggagggtgaaatgatgccatacacgtcacacagatctgatagtctctcgacaacttgagagagaaaatatgaaggggtatagtgattgagtcaaaggtcgaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgtctacatctgattggaaagaagccaggaaagtaacatttctcttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattaatgatgtcgtatagagcgtcctcattagcgatgtcatatacaatgtcctcattagcgatgtcatatacagcaacctcattagctatgtcttgtaaagcatcctcattagcgatgtcatatacaacgtcctcattagcgatgtcgtatacagcgtcctcgttagcgatgtcttgtacggtgtccttataagcaatgtcgtctacagcgtcctcgttagcatgccttgtggatgccattagcgatgtcatatacagcatcctcattggtgatgtcttatatggtgtcctcattagcgatgttgtgtacagcgtcctcgttagcaatgccttgtacagtgtcctcgttagcgatgccatatacagtgtcctcattagtgatggcttgtacactgtcctcattagtgatgtcgtgtacagcatcctcgttagcgtgccttgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttatatatatatactttaagttttagggtacatgtgcacattgtgcaggttagttacatatgtatacatgtgccacgctggtgcgctgcacccactaactcatcatctagcattaggtatatctcccgatgctatccctccccccccaccccacaacagtccccagagtgtgatattccccttcctgtgtccatgtgatctcattgttcaattcccatctatgagtgagaatatgcggtgtttggttttttgttcttgcgatagttactagcgatgtcttatacgctgtcctcattagcaatgtcgtgtacagcgtccacgttagcgtgccttgtcggtgccattagcaatgtcgtataaagcgccctcattggtgatgtcttgtacagtgccctcattagcgatgttgtgtacagtgtacttgttagcgacggcttgtagggtgtcctcgttagcgatgtcgtatacagctcgttggcgatgccgtgggcggcgtcctctttggcgatgccctgggcggcgtcctcgttggcgatgccctgggcggcgtcctcgttggcgatgccctgggcggcatcctccttggcgatgccctggacggcgtcctcgctggcgatgccgtgggcggcgtcctcgctggcgattccgtgggcggcgtcctcgttggcgatgccctgggcggcgtcctcgttggcgatgccctgggcggcgtcctctttggcgatgccctgggcggcgccctcgttggcgatgccctgggcggcgtcctccttggcgatgccctgggcggcgtcctccttggcgatgccctgggcggcgtcctcgttggcgatgccctgggcggcgtcctccttggcgatgccctggacggcgtcctcgctggcgatgccgtgggcggcgtcctcgctggcgattccgtgggcggagtcctcgttggcgatgccgtgggcggcgtcctccttggcgatgccctgggcggcgccctccttggcgatgccctgggcggcgtcctccttggcgatgccctgggcggcgtcctccctggcgatgccctgggcggcgtcctcgctggcgatgccctgggcggcgtcctcgctggcgatgccgtgggcggcgtcctcgctggcgattccgtgggcggcgtcctcgctggcgatgccgtgggcggcgtcctcgttggcgatgcccttgtcggcggcctcgttagcgatgtcgtgtacagtatcctcgttagcgatgtcgtgtgtggcgtcctcgttagtgatgtcgtgtacggtgtcctcatggggagctagaaaaacacagagttaaggtcagtgccctggtggtggagactgtgaatcacccaggggcttgcttggtgtgatgcatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagcctcccatgagtgcaagtgtgagttttttatccactttacgttcagtatgcattcacacatacaaaatatttttacaagaaatcagaaattttaatttttgtcagttatgtgaaatctaacttagctgccaacataaagattctatctcatttacttggtctcgagaaaatctagcacatagtaagtagaccaaaatgtttattaaatgaaaacacagagcagagataggggggctgctaggcagactgggttgcacctgattacctggatgataataaactgcacaaaacctcagtcaaattaatattgaaactgccttttgcttgggctcgtttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacagagttccctcatgtcttctacccaggttgaagtccagcaaaattgcgactgtcctctttacaacttgcgagaccacactgcttctgcatttgcctgttgtatgtatgagatttacacttgttttagagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaaaaaactctcatcacacatttatatatgtagcaaacctgcacatcctgcacatgtacccctgaactgaaaagttaaataacaaaagggatctgtgagctgagccaaacacctggggatctttgtgcttttgacacactgatgactatgccggtccgtggggagatgagcctataactgccctgggttgtgtgaccacggaggccactttatgatgatgggcagtgtctggggccttttgggctcgttgctttagggcttatacatgaatgctggactccctgtgtggtggtgaacaccccatgactaagtgcatgtcagcgtcagcactggtccacactcctgggttcgtgttttcactgtttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggcaagtgattccagaatacttactagattcaagcctcagaggggccacctgcaccacctgcaatacagaaacaaagctttttgaggggtatgtcatgttgtggattgtttgcacaaggctctgtttctctcaatgaatactgaaaacttgatcagaaagtgtagtcaacttcaaggcctccaaaacaagggtgggatacacactggaaaagacatcagcttctggatggtggatctctcaggtccacgtaggttggcaagtgcaaaatactgaatccaaggagaagacatcgcttccagggacaaggaccccaaggatacagtctacaacctgaagccggcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcaagaaatagagtccctggcattttgctgatggcaacttaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaataaaagcaaagtttaatagatagattggattcaattctaggcaaaacagtctatggtatttattcactaatcctttgttataactgctgatgggggaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacacgggttgaatgctggtgtgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaacgaagtttgtgaatctaaagttctacacaaaggtggaaatatttgcaaatcatttctcttgtaagagactaaaatttagaatatattttaaatatatttaagatatattcaaaaatctacaacaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgttaccctgatactttgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccatgatagaaaacacgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtattccctgtgaccacctcctttttcaactgaagactttgtacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccagggcacctcgctcatgcaaggtgcgtgtcctctaacaaagtttcacgctctaaacccagataacttttcaaacccaagttctgttgattcccctactttgagtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttattttcatcatttcttacatattggggcctaccatatattgtacagtgaaattagtgctatgcatcatggtagaaatataaattggcaaaagtaatttagaaaatagttcccttctttcttaaaaaaattaggctgggtgtggtggctcatgcctataatcccagcactttgggaggcagagatgggtggatcacctgaggctgggagtttgagactagcctgaccaacacagcaaaatcctgtctctactgaaaatacaaaaattatccaggcatggtggcgtgtgccagttgtcccagctactcgggaggttgaggcacgagaattgcttaaacctgggaggtggaggttccagtgagccgagattgtgccactgcactccagcctgggtctcagaaaaaaaaaaatttttttgaccgaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatggtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagaattaattcaaatggttgtcacaggtcacttaaagttagatagttgtcctacaaatatagggtgaatgttattcatgaatttcctgaatctattgcaataatcacattttttccattaaactcttgaggtagctaattttatttattgcattttcaatgttaatctactatttcatattttgagattaactcacattagtcagaatttacagtattttaaaatatcacagaatttaatttaccttaactggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgcttggatttcaataagaaacttgtggaagaacctgaagggtgggatctttgagggagcctaagacagagcaagacaagctaagaaggagggcagtgccacagcagaactgccgttgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgcgttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccgtcttgggtggtggcaagatgaggtagacgactgcttttgcaacacatacctgacaacaaaaaatcaacaactgtaaaagagccacaaaatccccaaatatttgcaaattagcaatgcacttttaagtaactgttgggttaaagaagtctcaatagaaaattaaaaatacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgtagacttcagataataatgtgtcaatattttctcattattctagcaaatgtaccacaataatgtaagatgttactaataggtgaaattaggaagtgagggtgaggagacagaataatatgggaacttcctgtattatatactcaatttttatgtatttatttatttatttatttatttatttatttattttgagatggagtttcactcttgtcacccaggctggagtgcaatggcatgatcttggctcactgcaacctctgcctcctgggttcaagcgattctcctgcctcagcctcctgagtagctgggattacaggcgcctgccaccacacctggctaatttttttggatttttagtagagatggggtttcaccatgttggccaggctggtctccaactcctgacctcagatgatctgcctgccttggcctcctaaagtgctgggattataagtgtgagccaccatgcccggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagacgctggttaatgcatttacaatagatagggctgttgacatcttgctgacagaagaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaggccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcatgccctgtgccagagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcagaccttccgacaccgcacaatgattgtcaaaagatgggtctgcaaagagtaacttcccttccactgattaaacctgaatatgcaagctactgtgaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccagtctcattcactaacctcaccatagtcttatgggttcaatggacctgtccaatcctttgctctgttctctccatcaccttcctgtgtaattttcctccaccatgcacataatagaaacatggcacaggggagctaatcacctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtatcctagtgtactacatcattgattttatgttatgaagatcatcatttattgaaaatgtataaataacgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgagtaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgacagttgtgctgggtaaacacaacatttttttcctgggggaaacacacatagacacacattcacaagcaaatcatgcagacttgcacacagaccacctcaccccacccccgccctaatacacacatacccacacacaacctaatgtgaacacattcccagaaactatacatagataaaaagagtatgtcacctggaaaaccagtttcttttactataccccacatcctcattcccaccagatgtcttggatcatggaggctctccagacaaaagccagcagttaagctccagatttcctatagaatccttttctaacaaccagtgagtgattccagaatacgtaccattgaatgtgctccctgacgtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttgttgaagaatgtttctgtctaggtaatttttgagtagcaattgcagaattcttatctaaagtggaaagcttgttcctgaagaaaacatctcttaacacgcagtgtactatctgacactgccaattttgcacgtcctctggaatcaggtgtcagctggtaaaatacacctcctccatccccaaggaaatattatctaacatctataatgtagtggataattttcccatagctgatatcaactgaaaaataaaggatccaagaaaacaacatttacatcttaggcaaagacaggctactttaccttggtagtagagtagggctgccttttcacacgcctttgggaaggcttcttcgagtcacctaggggatgtggagggacacagcattgctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaatgtgaaataatcaaactccaaatgaacaaatgctaaaatacatgctaggattcaaccacagcatcctgtcacttcttcagaccctttaaaagcccagcaggactgccactaccttcttgacatctaccaagtccctttcaacctccacagacccacatacactgctactgcatttatcatggagggtatagggttctgccttgtttatgtgtgaattttttaaaaactagatttaatactatacaccagcattaattatatttatttcttttcttggttatgaaaataatcagtcaggcatagtggctcacacctgtaatcccagcagtttggaaggtggaggtgggcagatcatttgaggtcaggagttcgagaccagcctgaccaacatggtaaaaccccatctcaactaaaaaaaaaaaataaaaaacccagctactcaggaggctgaggcaggagaatcccttgaacctggaggcagagattgcagtgagctgagattgcaccactgcactccagcctgggtgacagagacttcatctcaaaaaataaaaaaataaaaaatccggccaggtgtggtggctcacgcctgtaatcccagcactttgggaggccgaggcgggtggatcatgaggtcagaagattgagaccatcctggctaacagagtgaaaccccgtctctactaaaaacacaaaaactttgccaggcgtggtggcacgtgcctgtagtcccagctactcgggaggctgaagcaggagaatcacttgaacccaggatggggaggttggagtgagctgagatcatgccactgcactccagcctgggcaacagcgcaagactctgtctcaaaaaaaaaaaaaaaacctcccctaaaaataatcaattattaaagattagaaaatactgaaatgcttatattttaaaataaccactctaaccgtacattttccgttcagtcttcctttgccctgtgtttgcagtcatcgtgtgaggggctggccatgttcagcccaggcaacccacagccagagagggcagagcggggagatgggccctggtgagcactgaggctcttcaaaccagctgccaagggagttgcaagctgggtgacacatgaggctcattatttagtggtattttatgttcttacttgtccccagtttgtgtagctcacagactttttttttttttttaacatttctataggggtcatttgaagttcataacgccatcaaatatcagtacagggtcttcccattatttaccggctttgggatatgtgctgaggagtggccgcgcactgaaggaatgtgaccggttgtcccaagtgttgtcctccaactcaaaatccgcaaccagttcaaaagcatttgggcttttatgtgcctttcacataaagactatgacacagctaagctattcatgtactaatacctgccctgagctgtgtgaccacagacaccaccctataatgtgcccagtgtgtaggaactctacaggctcagatcattccacacatacatgcagatgttggaactcccttgcacagtgactcatgatcccaaggctgagtgctgagggcaggtcagtagttcagagcctcagcattggggctgtatgcttgggttcccatcttggctcttttgctgaggggctcataagcttgggcacattcatctctgtctttttctgcccagcgaaaggtgatagtaaatcaatcatgccatttgtctgtggtgatggccgaatgatttgatgtaggtaaagtgtacagtataagtgctcatgaggcttaattatcagtgaaatgtcttgctttagatttcacagcttaataaggctcagaggcttattcacgcccaggattctgacctcccaagtcattgttctatgacatacacctgcttggcctaaaaccgaccactttatcataatgcagacccagttttgaaagaagcagataaagttgtcaaaagtactgtgtctgcctcagcgcacactcagtgcgctccacacaaagggcatcaccatctgccacaatggcccagtggcctggctggcacagacagtggcagagcaaagggcaacagatccctaatccaatcaccatggtcgatagggcatcatagacattccagggtgaaggcacaatccacattgtgaggtccaactgctgccatgtagacaggtgtgtttttacatgtacaggaagatcattgaagataagtgttttatatccatggttaacagatgagatgaccatgaaatgaacaccagtgtactgggtggagcagcttatctattcagtcttctgcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattaacaagtaaacaggttttcaaagctctctacatgcaaatttacacaattatccttttaatttttatcttcatatatatgtacataatctacttgcttctgagtataaataaaactgtatgttcttagttaatagtctctaccaattcattctatttatctttctgagttgaaatactgcatctcattggataacaaaaaaaaatttgactaagattacactggaaaggtgagtaggttgggtaaatgactgtgattgacaattccatgattttggagaagtcccaaagcataaaaataaatgtgtgttttatttcacacgtagacaatacacatttttattactttaaaaaaataatatgtgaatggaaatgacttactacaaatttattaacgtaaatacacatttcacaaaaaaagaagagaggaagggaaaaacatgttaaaaacaaagagaggtacattttattgtgtgaaaagcctccaacccatccatactactgtggctttgttccaaagttttggaaagtaatgatttcataggttcttaataaggttaaaaactgcattaaaatagactttgccacattctcccttagggaataacttaatctgtagggtgggggatggaacgttgaaggatgcagatgtaaaaggaaattatatatatatatatatatatataatatatatacgtatatattatgaagatatatgtatatatattatatataattatatatataatatatatataatttgggaatttgggaataaattgtatcccaactcacactgggactacaccagctgccaccatgcctggctaatttttcgtatttttagtagagacagggtttcactgaattggccaggatggtcttgatctcctcaccttgtgatcctcttgccttggcctcccaaagtgctgggattacaggcctgagccaagatacatattttttaaaggaagaaaaatttcaaaggtactctgtttggtacaataatcaaatatataaattgaggaataaaacataaccacgaaacatatttataactgcatatggaaaatacagaggataattttttaaataacatattttgaaaaccttaactaggaatttgaaaagatcgcatttgacaggccagtatgaacacaacttgaacgcagcaagacaggttccccataaaaaaatcaaacacagggaaaatgaaaccacaaagtttcaatctgctctgacctttgaaaaactcagcacagacagtggcacttaggaccaacagcaggagatccctaatcccatcaccatggcgatagggcataaacattccagggtgaagtcacaatccacattgggaggtccaactgctgccaggcagacaggtgtgcctttacatgtacaggaaggtcattgaaggctcagtgttttgtttcaaaaactgaatcccaagaccaaacattgttatgctgtgcttcttaaaataagttatgagatgggaaagagggcaccccaaatatatatatataattatatataatataatatatataatatacataattatgtataatataatatatataatatacataatctccttttacatcctgcatccttatattatatataatatattatatataataatatataataatatataattattatatatataatatatacaattatatatgattatataattgtatataattatatatataatataataatatataatatctattattatattatatataatataatattataatatatatcatatattataatattatatgtaatataatataatatcataatatataatatatactataatattatatataatataatatattgcataatatataatatatacaatatattatgtataatatataatatataatattatatataatatgtcatactataatatatattacaatataatatatataatattacatatataatataaaatattacataatatataataataatataatataatatgtaatattatataatatgtaataatataatatataatatattatgatatatataatataatatattatatcttatgatatattatatataatataatatatgataatatataatatattatgatacattatatataatataatatatgatataagatattatatatgatatatgatgtaatatatataatgtataatatataatatatataatatgtaatatatattatatattatatattatatgtaatatatattatatattatatattatatgtaatatgtattatatattatatgtaatatatattatatattatatgtaatatatattatatattatatgtaatatatattatatattatatgtaatatatattatatatgatatataatatgacattatatatgatatgacatataatatatattatatattacatgtatactacatatattatatatggtatataatatatactatatataatgtatataatagatataatatataatatataatacattttatataatatataatatataatatatataatatataatatatattatatataatataaaaaatatatgttatataaaatatatataatatatattatatatatataatttttttgagacagagactttttctgttgcacaggctggaatgcaatggcgccatcttggttcactgcaacctctgcctcacgggttcaactgattgtcctgcctcagcctcccaggtagctgggactacaccacactgggactacaccagctgccaccatgcctggctaattttttgtatttttagtagagacggggtttcagtatattggccaggatggtcttcatctcctccccttgtgatcctcttgccttggcctcccatagtgctgggattacaggcctgagccaagatacatatttgttaaaggaagaaaaatttcaaagttactctgcttgttacaataatcaaatctgtaaattgaggaataaaacataaccatgaaacatatttataactgcatatggaaaatacagagaataattttttaataacatattttgaaaacattaactaggaatttgaaaagatcgcatttgacaggccagtatgaacataccttgaatgcagcaagacaggttccccataagaaaaatcaaaatcagggaaaatgaaaccacaaaggttcaatctgctctgacctttgaaaaactcagcacacacagtggcacttaggaccaacggcaggagatccctaatcccatcaccatggcgatagggcataaacattccagggtgaaggcacaatgcacattgggaggtccaactgctgccatgcagacaggtgtgcttttacatgtgcaggaggatcattgaagtcacagtgttttgtttcaaaaactgaatcccaagcccacacattattatgctgtgcttcttaaaataatttatgagatgggaaatatggcacccccaaatatatatatatataattatatataatataatatatataatagatataatttccttttacatcctgcatccttatatatattacattatataaaatataataatatataattatatataatataatataataatataaaatatatattactatattatatataatatataatatatattatatattaaacaatacaataacatataatatatgttatatataatactatatataatgtataacatatataatattacctatgatatataataatatatattatgtataatatatcatattataatatatataatatagtatatataatatgtattatataatatctaatattatataatatataatatatcatatataatatattatgatatattatatataatataatacaatataatatattatatattatgatacattatatataatataatacaataaaatatattatatattatgatacattatatataatataatacaataaaatatattatatattatgatatataatatgtaataaaatataatataattatatataatataatatataacatataatatttatgatattatatatatataatttttttgagacagagactttctgttgcacaggccagagtgcaattgcgccatcttggctcactgcaacctctgcctcattggttcaagcgattgtcctgcctcggcctcccaggtagctgggactacaccacacggggactacaccaggtgccaccatgcctggctaattttttgtatttttagtaaagacagggtttcactgtatttgccaggatggtcttcatctcctcaccttgtgatcctcttgccttggcctcccaaagtgctgggattacaggcctgagccaagatacatatttgttaaaggtagaaaaatttcaaatgtactctgcttggtacaataatcaaatatataaattgaggaataaaacataaccatgaaacatatttataactgcatatggaaaatatagaggataattttttaaataacatatttcaaaagcattaactagcaatttgaaaagatcgcatttgacaggccagtatgaacataccttgaatgcagcaagacaggttccccataagaaaaatcaaaatcagggaaaatgaaaccacaaaggttcaatctgctctgacctttcaaaaactcagcacagacagtggcatttaggaccaacggcaggagatccctaatcccatcaccatggcgatagggcataaacattccagggtgaaggcacaatccacactgtgaggtccaactgctgccatgaagacaggtgtgcttttacatgtacaggaaggtcattgaaggttcagggttttatttcaaaaactggatcccaagcccacacattattatgctgtgcttctcaaaataagttatgagatgggaaatagggcacccccaaatatatatatatatatttataattatatataatataatatataatatatataacacatatataatttccttttacatcctgaatccttatattatatataacatattatatagaagatatataatatattattttgtacataatataatatatataattatatctaaatatataattatatataattatatctaaatatataattatatataattatatctaaatatataattatatataattatatctaaatatataattatatataattatatctaaatatataattatatataattatatctaaatatataattatatataattatatctaaatatataattatatataattatatctaatatataatatattatgctatattatacataatataatataatgatatatagtataatataatatatatcatatatatcatatattatatatcattatattatatttaatagatatcatatattatatatagtatatatcatatattatatataatatgtaacatataatatataatatatatcattcattatactatatattatatataatatatatcatatattatatacataatatatgatatatattatatataatacatggtatatattatatataatatatggtatatattatatataatacatggtatatattatatgtaatacatggtatatattatatgtaatatagtatatattatgtaatatattatatactatatgatgtatatattatatattatagaatgtatattatataatatgttatagaatgtatatattatataatatataatgtatatattatataatgtatatattatataatgtatatattatataatgtataatgtatatattatataatatattatatgttgtataatgtatatattatataatatattatatgttatataatgtataatgtatatattatataatatattatatgttatataatgtataatgtatatattatataatatattatatgttatataatgtataatgtatatattatataatatattatatattacatatccaatatataatatattatatatatcatatatcatacattatatattatatatgatatataacctataatatataatatatattatatatgtcatatagtatatattatatgtcatattatatatattatatattgttcatataacatatattatatatgatgtatattatatattatatataatatattatgtatataatatattatatattatatataatgtatataatatgacgtataatatatataatgtatataatttgacatataatatatataatgtatataatttgacatataatatatattatgtatattatgtaatatatcattatattatatatattatatattatatatacataatttttttttagacagagtcctgttctgttgcacaggctggaatgcaatggcgccatcttggctcactgcaacctctgcctcacgggttcaagcgattgtcgtgcctcatcctccctggtcgctgggactacaccacactgggactacaccagctgccaccatgcctggctaatttttcgtatttttagtagagacagggtttcactgtattggccaggatggtcttgatctcctccccttttgatcctcttgccttggcctcccaaagtgctgggattacaggcctgagccaagatacatattttttaaaggaagaaaaatttcaaaggtactctgcttggtacaataatcaaatatataaattgaggaataaaacataaccatgaaacatatttataactgcctatggaaaatacagaggataattttttaaataacatattttgaaagcattaactagtaatttgaaaagatcgcatttggcaggccagtatgaacataccttgaatgcagcaagacaggttccccataagaaaattcaaaatcagggaatatgaaaccacaaaggttcaatctgctctgacctttcaaaaactcagcacagacagtggcacttaggaccaacggcaggagatccctaatcccatcaccatggcgatagggcataaacattccagggtgaagacacaatccacattgggaggtcgaactgctgccatgcagacacgtgtgcttttccatgtacaggaatgtcattgaaggctcagtgttttgtttcaaaaactgaatcccaagctcacacattattatgctgtgattcttgaaataagttatgagatgggaaatagggcacccccaaatatagccaatagtgagagtttcaaattgaagagaggcacaactgatacgttgagaataaacagagattccattctgctttttcttttttaacttttatgttagattcagggtgtacatgtgcaggttttttcctgggtatattgtgtggtgctgaggttttgggtgtgaatgatcccaacacccaggtactgaacatggtactcagcagtttttcaaccttttccttcctccctccccctcctagcagtcctagtgtctattgtcaccatcttcatgtccatgggtactcagaatttagctcctacttataggaacatgaggcgtttgttttcttttactgcattagttcacttcgtggattccagctctagacattttccctcaaagaacataatttcattcgtttttgtggctgcatagtattccatggtctatatgtaccacatttttatccagtccactgttgatgggcacctaggttgatcccatgtctttgctaatgtgaatagtgttgcaataaacatataagcgcatacgtctttttggtggaatgatttgttttcttttggatacatattcagtaatgagactgctgggttgaatgttagttctgttttatgttctttgagaaatctccaaattgctttccacagtggctgaactaacttacatccccaccaaaggtgtataagcattcccttttctccttatccttgccagtatctgctatttttttttttttactttttaaaaatagccattctgactagtgagagataatatctcattgtggttttgatttgcatttctctcgtgattagtgatgatgagcatttttttcatgtttgttggctgcatgtgtgtctccttctgagaagtgtctatgtcttttccccctttttaaatggggttgtgttttgcttgttgaattatgttccttatagattctaaatattagacctttgttggatgcatagtttgtgaataatttcccccattctgtaggttgtttactctgctgatggtttcctttgctgtgtggcagctctttagtttaattaggtcccatttgtcaacttttgcttttgttgcaatttcttttgaagacttagtcatgaattatttcccatagcccatatccagaatggtacttttgaagtttttcttctaggattattgtagtttgaggtcttaaatttaaatctttaatccaacctgagttaatttttgtatatggtgaaaaggtgaccagttttttgttttttgtttttgttttttgtttgtttgtttgttttttgagaggtagtcttcctctgtcaccaggctgtagcagagtggcgccatctcagctcacagcaacctccacctgccgggttcaagcgcttctcctgcctcagcttcctgagtcgctgggattacaggcacgtgccaccacacccagctaatttttgtatttttagtagagacagggtttcaccatgttggccgggctggacttgatcttctgaccttgtgatcctcccaccttggcctcccaaagtgctgggatcacagtcgtgagccactgtgcctggccaataaggtgcattattaacatcaataaagctcaggaaacagctttcaccatatttttgtttaatttacagtttttcccagagtctttggaatagattcctccctccatgagccagagaacttacaatgttcactacagtgtctttaaatgtagcagtagcagctgtgggttgagaacacaagtcttcgactcttccttttagagccagccattcacggtgctctgtgttcttattcggcattgggtaggggcatctgggtgctgggcatagcgccagtgccccatggaggagggaggcaggaagcccctttcttccttctctaaaaccttttttctttatgtagatccaagtttttagcctatatcattttcttctctctggataacttcttttaacattttgacagatctactgacagcaaaattgcatttctctgagaaagtctttatttttcttcactttggaaagataattttgcaggatacagaattttaggttggtggaattttcttgcttgcttgcatgggttctgaagaaaagtttgatgcaatttttattcttatccttacatgtgttaggccctgctaaagcccaaggtggttagactcttgtgaaatagtttccctggggcaggcttttgctaagggaacggaacacccagggtgtatttcaaagtagttacttttccccttccctgtgggaagcaggagggaatttttctctgatgtgcataagagcgtctggcagagctcttggaggttcatgaaagtgtagggccccctaagaccgggctcccttaattcttaattctcaagtttatgtacacgtggcctccagaaatttgttgtttacatgtaagtcttcccaccgtggttctggctccagtggcagcctccgatcctgttaggctgggactcactgcctctccaatttgggggataatggtttggcgtgttaacctcaagtctctgatggatctaagaaaagttgttaattttcagtttgttcaaggtgttttttgttgttgttgtgaggacaggagtgacagcttccaagctggaaaacagaagtcacatttgggttttgtttcaagatatttttccaatgacagagaatgatgccacacacatttccatagatgtcttttgatgcagacgtgcatgtgtttctgttatcctaagagtgaaatacctgagtcctgaatgtgctcctttctagaacctttattcaatgccaaacacagtatcccctccagcagtgatgagagttcttgttgctccagattctctccaacacttggtgttctgtcttttacattttagccgttttggaggatatgttatcctgttgtgatgttaatttgcatttacatgaatattaagaaagctgaacacattcaagtatttgcttttataaattacatgtttaagtgttttacccattgttctttctcttagtgattttttttttttcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggctgggggctgacccccccacctccctcccggacagggcggctggccgggcggggggctgacccccacctccctcccggacggggcggctggctgggcagaggggctcctcacttcccagtaggggcggccgggaagaggggctcctcacttctcagacggggcagctgccgggcggcggggctcgtcacttctcagacggggcggttgccaggcagagggtctcctcacttctcagacgggacaaccgggcagaggcgctcctcacatcccagacggggcggcggggcagaggcgctccccacatctcagacgatgggcggccgggcagagatgctcctcacttcctagatgtgatggcggccgggaagaggcgctcctcacttcctagatgggatggcggccgggcagagacactcctcactttccagactgggcagccaggcagaggggctcctcacatcccagacgataggcggccaggaagagacgctcctcacttcccagacggggtggcggccgggcagaggctgcaatctcggcattttgggaggccaaagcaggcggctgggaggtggaggttgtagcgagctgagatcacgccactgcactccagcctgggcaccattgagcacctctcttagtgatttttaagagctctttacatattgttgatgtgagccctctgtcagttctatgtgttcatagatctgttcccactctgcaacttgccttgtcactttcttagtctcttaataaacagaaattcttaatttgaatacagtctaatttatcaatttattcccttaaaactatggctctttgtgaactgtttaagagatctgtccccattcatggtcataaaaattggctgggcatggtggctcacacctgtaatcccagcactttgggaggtcaaggtgggcagatcacctgagatcaggagttcgagaccagctggccaacatggtgaaaccctgactctactaaaaatacaaacattagccaggtgtggtggcgggtgcctgtaatcccagctacttgggaggctgaggcaggagaatcacttgagcccaggaggtcaaggccgcaatgagcagtcattgtaccactgcactccagcctgggtgacagagcaggatgctctttcaaaaataaacataaaagtaaatctaatgagctctaggatttctaatttgaagatagaagcgataaacaaaataagaaaccaaaatacattctgttttgattaaagcagaggtcagccataactctgaacctaaaaaggaggtcacctgaagcagctgtgagtaagcagggtaagataggaagcagagaaccgatgctcattgccagatcttaggaaaaaaataataaattaggatgacatacttttgcaaaattaaagaaatcccctgaggtgctaatacaaaatttcatttgtgataggactaataaagaaattcagctagtagtgggatctgtcgtggactgagtttgattccaagaacagaagaggcaggaccagtgagaaatagcacagacatatttgcaaaagcagccctcccacgttaggaagaagggatacttttgcacagtgaacagcactacaactgctcatgtctttcatgtactatcacacatggaatgactgagataatcctgtgttccacacatagtcctcctcccatcccccaccacttaggcaagagctgtgcccaggaaatgtcacccgtaactggtctgcacagaccctgtcttctaaaagggtgctgtgcctccaccagaccccatgagcaatacatttgtcaagcacacgcgagacatgccaaggccaaggcctgactgatttgacagtaaagacacaatgagcccctctcattcagagcttattactcacagagtgaaaataagagaagtctgaggtggcagctccctgccatcctggtgccacacactaaaaaggacagcaccgaaacaaaaggggtcagagggcatgcattgcaggacacccaatgcagaggagccccttgagactgcagctgggtggtgtcctcatctgcagctctgttgtgagggccaggggcagggcagtgaggaaccctcaccagggccagtgaggcaggcagtgaggaacagtcttgggagacagaggaagtgaccagtggcctgggtgcagcctgatgttctgggaggagcaggcttaggtcaggtgctgtgtgcacctctgtgtggcctatggggatcctgcaatggctcagggtctcacggcagagctgtttctctgcccacacaatggactcacaacctgacacacgaaaattcacagagaaacacagaaaggcacacgtgacactcaaagacagacccacacaaaagccatgcagcaaagccttttgccacacatgcacatgcacacacacacacacaggctcccatcctttcaaaccacagacttggtgtttgcccagacacacctgtgtcagagaaaggggatctgcagctccccaacatacaccagtcactccacactaacccaaggtgtcaccagccagcctggaggacttgggaagctaagtggaggtggacagtggccacagagcaaaggccttcagtggataccacctgatgtaaagagccatggggtccaccatgtgcacgcacacaaggggcacacatgtctgcgcaccagctcccccattcctacacacatatcacccatccctagggctctgggggatgagacccctccctgaagacccacaggagtccccatgcctgagtgacccactgctcacgtccatgcaaaagaaaagaactttttatctgaggaatgcgagacccctttaattatctggcccagagagtcactggactgaaacagcagtcacatgtcactcccacttgagctaacgacctcttgaagccaattgctctgtgggttccagactgacaccaagtagacataaaaagccagacgctggacaccataactcttcccctgtagtccaacaccttatagccagtcactaaggttctctctggaaagcagtcagaattcctgctgacttcatatcagcccactccttgtccccttcagtctttaaaaacttgcttgtaataaggctgaatgaagtactcccagggcaacttggtgtgtcctgggcagctctctcagccttggtccagacaaactctctatatgaactgtggttcagtttgtttctttaggtcgacatccacattaggggagcagtgctgctgggctggggaagctggttcaggtcagatgttgcaccaagggttggagaaggggccttcctgcatcagcacccggacaaggcagaggagcaggtgtccaaacccaggcctggtctgctgctgctgtggctcacagcccccaccccacctggcagacctggcagaccccggagctggcgacagtgttgcccagctggccacagacatatcatcacgtggggctgccctatatgctcccagtctccacacagacacccttcatggactgggggactgagggcagggacactggtgaaacaggcaggcatcttcacccagctactcatcccactcaccacctccgggggaggtgacagtgaccaagcccagccccagctggctcctggtcactcactacagactcagctcccacaatctcgaatcccacctccagctcctgccattccgagggacctggaggccagggtgcccggcgcatgaccagctctgggttgtggaccgccctccacggcagtggcctgagcgcttgttgtcattattcactttattcactcctggtttctgtctggaagggatcacaaagacatggcttgcaggggagccaatcctgccagggactgaggaaacagatcctggagaaaaccagagactttgctggcacttcagggggaccccagttggctcaatgcccccctctcccccatagccaactgctaaccaatgttctctctggaaaccagtcataattcctaacctggtcaaagcagggtcatctcacacagcccagccacccattctttagcaccgcaggcagctaaagaatgcctggtgaaatgcaagtctgatcgtgtctgcgtccccaagcccttccgtgccccctgctgctctttggacaagcccccagcagcctctgtaatgcacagcacccgcccttgtctcctgtgctggcttccgcagcctggccacactggtcctctcgcccatccacctgacctgactctggcagggcctttgcaggagccattcctccacccgaacccctcctattaaaacgtgttcctagccggttcagccccagcctgtagggaccagccccacatggtcggtgggtctctccccgtgtgccgcaacgagagagtgtagaaataaagacacaagacaaagagataaaagacagctgggcccgggggaccactaccaccaaagcgcggagaccggtagtggccccgaatgtctggctgcgctgttatttattggatacaaagcaaaaggggcagggtaaagagtgtgagtcatctccaatgataggcaaggtcacgtgggtcacgtgtccactggacagggggcccttccctgcctggcagccgaggcagagagggagaggagacagagagaaagatagcttatgccattatttctgcatatcagagacttttagtactttcactaattgactactgctagctagaaggcagagccaggtgtacaggatgactaggcataataaaggcagactaggagcgggaccactgaagcacagcatcacagggagatggttaggcctccggataactgcaggcaagcctgactcatgtcaggccctccacaagaggtggaggagcggagtcttctctaaactcccccggggaaaaggagcctccctttcccggtctgctaagtagcaggtgttgttccttgacacttttcactaccgctagaccacggcccacctggcaacgggcatcttcccagacgctggcgtcaccgctagaccaaggagcccttctggtggccctgtctgggcataacagaaggctcgcactcttgtcttctggtcacccctcactgtgtccccttagctcctatctctgtatggcctggtttttcctaggttatgattatagagtgaggattattataatactggaataaagagtaattgctaccaactaatgattattgatattcatatataatcatatctaagatctatatctggtataactattcttgttttatattttattatactggaacagctcgtgtcctcggtctcttgcctcagcgcctgggtggcttgccgcccacaccagccaccagaagctccccagccccggcccagcagctggtctggggagcggggagagggcagtctgggctcgcggttccggctgggggctgggcaccccggggcgaccacggcaggcccagatggggactccggttccaactctcctggcccagaggctctagggtggtcttgtctgtctcactccgggggcagagaggacgcagacagaccccaacaccactgctcggccgcgatggtgccttagacccaggtcctgtgggctctggcccgagacccctccctctgggaaggccggtgaccgggacagtccacctcgcaggcgcgccggcgcggagcccggacctcagcccgcaatgactcagcaagggccggtgggattctacatggtcctgcgatatccaggcgacggagtctcgcctctaaagtggcccggggagcaggaaggtatgagcctcagctgagcgaaaccctccttgcagccaccacggagggacggggcgcgtctccttctgaatgacgcaaggggcggggcgcgtggtggggcggggaaggcgcgaggcgcgccgcgatcggggactgtcctaagacgggcggggcgcgctgcgctagggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccaggtacgcgggcggggcgggcggcggcctgccgaggccgcatcgtgtcccgccggggctcaccgcgctcctctaccccgcagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtgtagtgcatacgcttgtgctctccaccgaaagttcagtagttaacattttgctctagttcttgacatcccaaaatacatacatgtgacagcatagaattcaccaagagtcttcagcattcctggagaccaggattttcaacccagccatgctgacatttgtggctgggtaagtctttatggtgagatgctgtcttgcgcattgcaggatggcaggggtaccctccctagtcgtgaaaaccaagaatgcctccagacaacctgggtggtggggtcaaccttggccttggattgggagcaagtgctctagaacaagagcggtctcctacacagctgcagagggtagccccctgagaaattaactgttccaggtgtctcctgactttcagtgcatggccacatcatggtacctaacttgtggcaaattgttgctttataagtaaggatccagtccaagttcatgtactacaattggttactttggtctctttgcttctggaacagtccccaacatttattgtggcattgactttttatagagtctaattctataattagaatgccctgctctggatctatcagaggaaatgcttcctcgtgcatttaacctgcttctccactctctgggtttactgtacactggactcctggtaggagcctgattagaggcaggtttaatgtggcaaaaattcctcctagcggggcaaggcccccttccccagaaggcaggcagtgtccatctgctccaggattggtgtgtttctatcaagaatggatgttggattttggcagtttcctttttggcagctcttgagatgatcacgtggtgaatcattttctattactacagtgaattacagtcacttgaattccatcctactgggtcgtgctgtagtatcctttttatgtatgctggatttgatttgctaaaatcttgttaagaatttttttgtctatgttcatgataaactgtggtctatagttttcatgtaatacctggtttgggtatcagggtttttgccagccttataggatgagtttcgaagtgttctctcctcttcagttttccagaagagtttgtgtagaattggcattacttcttcccctaaatgtctgggtgactgtctttttaaaaattttattgagctgtaagatgcatgcagtttactaatcccaagtgcatggctcattattccttaatgctcagactgtgccatgtgtggccagttgggggcgctccaggcacctttagatgccgccccatcattctgtgagcactttcttgctttctggttcaggtatgtgttcaggctcatcttttcttgttttctccgtgtctcagtcctggaatcggccatttttccacagagttgtagttctttctagcaggatggggagtttcagtaactgcctgggcccaatgctgtttgtgcttcagaaggtttgggccaggtcctggttccaccagcagcaggcatgcctgcgttgactttctgcttctcctgctgatttggcaggggtgactggctgctcctgcctcctttgtgttcccggtcgtgtctaaggccaggccccttctgcccaggcagccggcgtggctctcttcttgccttttggttgcatatctagtggaatctcgtagtggacctggcacttgtagcaatgtttgatcagtagagtgaagatgatgacatttccctgcttccctgtgttatggagctgtcttgaggggggcttttggtaaataccatcgtcgaggtgtgtacagaatgccaagaaacaggagattggggaaggctgtaggcacagctggagccaggctacctgcaggggagcctcaggggccgtggagttccctggagacttgccaccagagaagagctgcaacatcagggctcttcccaggaacagagtgttggatttcacgttttgttgtggccagggacccctccttcctggggaactgtagccatttggcacttaatgcactggcgccagctgcggggtgctccatgttccattttgccatgatggtttatgtcccatgatcgcttcctctgtacactcccttcagactagagtttgcacatctgtgtttgtgcacagtttagcagggaccgtggagctttgcttggtggccgagggtgagcccctcaaagccacacagactccctggcccagagcctcacaggcttatgacaccccaggttcatcccaaacttgggcctcccaggtcagctcacccttctccctctggtgctgtgtaggggctgggagctgcaaatgggggagggggctgcccaccctgaagggcagcaccaagggtggaggggccaaccacacacctggtaggcagaggccccacgctcagggtcagcgacccggctcctcctgctcctttcccatgcctttgcctgaggtggtctccaacacttgagtagatgtcctatggcctgtggccacgggggccctgaagccctcagactgcagcctccctcccgcctgccccctccagctgccctgggtctggggctgcagctttggccccacctggccagtcttccccacccccactctctttcagtgccccgcaccttctggaatcccctggagacttgccgtgacagtggggtgggaggatggaggaggctggcgtcctccccagtgcagacacccctttggcctggctgctctgctgggttggtaaggcaggtgcccatgggtgagggctgctgccgagtcccaccgcctgctgacgggctctcatccctcccagtgctcaggcaggcgctgcggcagaagcaccaggaagcccagcaggcctgccggccccataacctgcctgtgcttcaggcggctcagcagcgagaactagaggtactggggacgcaggcagggtggccggcccagctctcctgtgggcaccacctggctctgctgactgggctgagctgaaggggtgtggggggctcaggtgtgggtggctaccctgggcctgagtgggacactggaggcctagtgagtcccaccaggtggctcctcgctgagggtgccaggtgtgctgggactgggtggagggtgagaacccaccagtgctcccctggagtccattagtgcccctcgtgggttggggtctccgcagagcaggtggcctcggggggtacaaaggcaatggtggggtgatggggccagccaggaaggggcccatccttctccccgggagcacagggacaaccagagaccggcatgtaaccaacaagtcatggggcagggtgtgcctgcggagatgtgtgtgtggtcccaaggcagtcccaagtcaaagcattcgtggaagccccttggggcccccttcaggggttcacttggccgaggagaggcctgggtgtggtgaggatgcattggtggtgtcagagctggtgctgttggggacagcagcaggagcatgtgtttgagctgccctcacctcccccgccgcccccggccccacggcaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggtcagtgcctgggcctgctctgtcctagcccgagtgcccctgggccccattccatctgggatttcactgctggtccctggggagccaggctcagggtatagggggtgaagtggaaggattgaggctctggaaaggatttctgtgccattcccagcatggaggccaggcccattccctacaggggggtgagccagccagccatgggcactgcccaccctccccaggcctgctgtgccccacagggccctcttctgctcccctcccgcatgccattccaagtggccctgctgggtgcagaggctcagattccgagtggccctgctgggggcagaggctcagattccgagtggccctgctgggggcagaagctcagattccaccctgtcgtagcaggccatgaccaggcttcacaggatggtcgccccgtgggctcactgcctggcacctttgggccgggatgaaaggggcctgggggtcactctggccttcatggggcccctctgtatcccaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgcatgtggcttgtgtgatagctgcaggttctgccataaccggggccctggtagggcccccacctctgttgcagcagaggcctctacctgggggccccttcctgggctgtgtgcccagcccaccacccctccccctgcctggagactgggaccctccagcctttcctgccccagccctggtcccaggatgctgtcactgccatctgtacaggggcccccatccaagccccagggcatgaggaccacatccagcctgctttgtggggctgggggctggagagcatgggagaaggcccgaagtgcaagtatgcgcctgccgcagcctggtcagtgtcctgtgggaaccactaggaggagcctgatgcaggtcactggggtagaggactcagggtggcaggaatggcctgaggaggagccctgcggggaggcgtgccaggcccacctggggagcttggcctctgcatctgcatgagtcccctccgtgctggcctgggcccatgggccctgctgggtccttgtggagtcagggttgggggtgtccagcaccctgggtggccaggtctgcgcagggcctggcccccaggaacagatgatgctggaagccagagtctgggatgagacttctctgaccctgtctgagccactccctctttgttgcccagagctgaccctgtgtgagggcaaagggctctcagctgcaggaacagtggtttattgaccaggcaggcctccccagcccggccactgctccccaaggggctcgggctgtgtgggctggccttggcagaaggtggacaatcctctaggtccaaggacatgggggtcacagaggtgggggccttgggcccacacattcgaggagagttcccaaaagtttccagtggctgtcccaggcaggtatcaggttcggcccacacctgagtgcccatactctgggcagggctgggaggcacctgacctcacctccagcagctctgcaagtgtggggtgaaaaaaggtgaatctgtgtgaggatggggttggctgcagctgtggtgatggcctgggcgggggcggggggtgctggaggctaagggtgtgctggcgggtgctaggcagggcgatggaagaggttgccagttcggagccgcctcaagagctccagccacagcagctgccgctcccgatgggtgcccttcatgaggctgctgttctccagggcacggcgggacaagtagggcagcacctccatcacggggccatagggcacgtacttgtacacggggtagccggcctggcctgcatgggggcagatacaccatgaggcccaggcccagcaccgtaccccatcgcaccagggagggccccactcacccagcgggaagctgatctggtcacacatgcctagcagctgtccaaagtacacccggtggtcagcaggatgcaggcccagctcctccatcctgtgcaggtgaagccaggaactgagggccagttccaggacactgtccccagtgcagggatacagggctcctgtcccagctctgagcctgtcctgccatcccaggtgccccatctgcactctccagacttcatcccctgcaaggtggggctggggtatgggctctgcctggccctgccccagtgaggcctcttcccagcaggactctgctgggctgccctactcgtctccctggggaggcctcagcccttggccaacaaggcctcccacctgctttccctcccctctcctctctcacctctcctctagctcccttcttggaggtgcagcccttcctcgggccctgacccacccagcagcctgccccacagggcagagaagctcctcagctctcctgccatcccttcctcaagcccctccagggttctgtggtatgactggtctccggcccctgccctcgccctctgtgggctgctgccctgccccatccccacagctgctgtgtcccacacagctgccaccagcccccgagtcctcggaaggcggctgctctgaatcgagatgtgttgcaaatgtcaaatacacacgggatttaggagactttgtagaaaaataatgcacgatgccgcgttgcttttctaaaagcaactggaatacaatttgaagtaatattttgaatattttgggttaattaaaattattcttgaaattcattttatctttttcctttaacgtagctactaaattttaaattacagatgtggcttgcattatatatctattagcactgctcagatactggggtggggcctccactctgtcctgtcttcacaccaccccgtatagcgtcttacaaagattctcagggtctgaaatatccacgcagtggcagttctcaagtttcatctccagcttactatatccaggtatcccgacttcgctggtctgcaaagcactggggtccccaccctggggtgagttccgcctgctgctcacgcatcacccgggaccacccagtctaaagcaggcacccatctctgccacatcgccctggcttccatcttgtgtcttcctcaaccccaggacatgaacccgagagccgggtgccactgctggctgccccctcccctgctggtgtgcacagcctctgccatgtgactgcggctcctcccagcacaggacagtggctcactccacctggcatctgggcttggcctcgtgaggcactttggccagcagggaggtaccaaaggtgacacaagcagaggcttgccctctccaggccttctggaagcctgagcccaccacgtgctcaagcctgggctggcctgtgggacgctggacccgggatgcagtctcctttactgccccagccatgaatgagctcattaggccccaccggccccagatcacagacgcaggagggacacaggcacagccagcagcagaagcatcagctgagccagcccacccctggcctacagaacatgccactgttccagcctctaagtttggggctggtttgttccttggccaaagccaactccgattgtttgagggtgggtggtgtggcagtctgggcccagcacaggacagagcagctgccatagtctagaaccacttacccatgggaggggaccccagctccccagagctccccaaccacccacagcaggggcagagctgaagcctgcaggggtccagcctctcaggcagggatgtgagcgtggtactgggggagcctggcacagggcccttggggccaagaggagagagcccggctgccactcaggggagggggaagctgtgtccactggggaagccactgccacagcaagatagtagggacagacaggtgccgggcggaagctggagagaggaagccctgctgagggcaggctgtcctttcggagttggatggtgatgtgtctagtcaggctgtgagtccaccagcattgagagtccacccagaggctgggagtcctgattacaagctgagaggaacccccaccagctcccgagtgctgggcagtgctggccaccaggcctgtgcgtgtggagaaagtgagtctgtcccatcaccgacacatctatgacaattagcagaggatcagggcacaaaaatgggtgtgctgcaatttcaggccatgaaaaagtagcagcatcgtaaacaaaggctgaatgtggacatcactgaatgatttcagagccgtgagtcagctcccgagcagcaccaggatgtgtcctgttggctgcagccctggccccaagcctggccctgtggcttcacagcttcttggggagccccctcgtgccacaagccctggatctggggcaccctgccctgctgagagtggagctcctgctcagctcctaggaaggcgagagccagcgaggccactgcccaggcccccgagggttctagggggtcccatccctgggaaggcggaatctgggaggggagggggacctaggaccccattgtgtgcatagcttggactaaggcatgagataagaccagggtgacagtacaggagtatccaagaactgacttcacctaacttctgcatttgacttgttagaattctaccgaagttgtgctccatgggacaaatgtttaaagagaaaacaaaccgttacattccagatgtagttaaaatgttaagggcgtattaatgaggtggcactgtggaggcctcctgagggactggcctccaacactgcatttgtacctttcaggagccatccgaataccctgatgaaatttagttttttaattgtgaagtttaataagtcagatgttaatttttaaaagtctgggtacagtggctgatgcttgtaatcccagcactttgggaggccaagaagggaggatcacttgaggccaggagtttgagaccagtctggccaacacggtgaaaccctgtctctgctaaaaatacaaaacattagccaggcgtggtggcacatgcctgtaatcccagctacttgggaggctgaggcatgaagaattgcttgaacttgggaagcggaggttgcagtgagccgagaccacgccactgcactccagcataggtgacagagcgagattctatctcaaaaaaagaaaaaagttaattttaaaaaccaacgtaactgcaaaaagccattgtgctctcacagtccgatgtccagaacgccagcgggcctgggcctgcccactgaagccaccctccagctcatttcaccagcctttccccacaaatgcccgaccacccagcaggtcgctctgcccaccctgagctctgcgctgctgccacctctccccagccggaggagacaacggctcaggttggggtttcggtgcagggtggggcacacctacctgcgcagtgcaaagcgcactgtgtcctcattgtgggaggccaccatcaccttggccttggcgttgtgcttcagctcctccaacacgtagtccaggcacctgtggagagtgccatgtgagcccagttccaggcctgtggctgcctgcacctctcattaccagctgcacagagaggaggccgagggcagacccagatccatccattgagctggctctttccaagggtatccacaggatcaggaggaacaggagcagcatctgcccctcccagcacctcatgaaaaagaaagaccagcaaccaagcaaaagcgatgtctgggaccagacaattcacgcagaaccagctgtgggggcagagtccctgcatcaaacgtgctgtgactctggggaccagcccaaacatgcccatgagcctcatgacagacacagctttgcttctggggagggatcgtacagtgcacccctggccctgcaaggaaataaaagggaagcaggtccctgtagggcacagtgggggtgggcatcccggtgcaccaggaagcccgagcagtacggccctcctgcagcgaggtcactcagcaggcttgaccacacgcacgttctctctgacccagcaattccatttccagcaacctaggacagctgcatcctcagacacaaaacccctgacggcccgtgtgtaccacagagggtgacggtatgtccagcgagtccattacaataaccagactaaaaaccaataagatcaaagatgctggacacatagccccgggcactccatgctggctgttgacagcaccactctgcaagcccacacaagaggacccagatggaacgcgaaatgaaaaacacatcgggcagaggacacgctacaacgcaaaaaacaatggcggagatgtgtgcgctgtggcacgacatgcacagcggctgcaggaggggagctggagccaaccaggagacacttggggtctctctgaatttgcagcatgcacacacgcctctaagaggaaaagcccatggttggccagcctgtgctacatgaaaagatcaccaagaaactagagcagtaaaagcaggtgcagaacagctgatgggcgatcccactgtgtgaactgaaaagcaaacaggctgagcctgcagggtggggaggaccgggtgttcatgcacatctctggatctaagtgtctgcaggagcaagctcagggaactgtggccaattttgctttgttcaataggcttttctatatttataaaagaataaccttaatgcttttgaaaaagtaacacatgacataaaagctgaggaaataccagttctgacctggggacacatgtggctgacaagttcagtctccaagcctctccctcaggcctggtttcttggcgccctgccctgagaagacagaggggtgggagagctgcgcacctgtggtacatggcgttggtggcctcgtacgtggggttgatggggtcctcatagccgatctctgccgcacgggctcgctcctgggccaggtatgcgccccgcaccagcttggccccaaaacaccagccctcacggcgagccagctccacgtccagggtcacattgtcataggcatcctgtggggccagggccaaaagtcacagggagcctgggcaagcccaagtgacagcaggatggggccttcctgggcccaggtgcagtcaccagggctgggcagcagctgcctggggaggtgcagctcagggcacctggagcaggtgtgggtgaggatgggcctccaacctctgtccccaaggagcaatggcagtggggacgtctgcaacttcctgtgtggcctgtggacggccctgtgggtgcagcccaggcgccagcagccatcatgtgctccagactcccaggccgaccgggaggggtgcatactgcatgctcctgcctggacccctccccatgccaccctgtgtcctctgggcatccggctcacccctgagagctctggacctgctaacatccctgagcagtttggggcccaaaggctagggtgggctccctgaatacatgtgacatcctgggtgagtctttccggggagggcccaaagctttcaggaggttcttaggggcgctgaactgaaaacacgctggaggaaatggtcatgtgacaccttccaagtttggggtgtcgggtacatctagtggaccctcataaagattgttgtcttcctcctgctccttagacactcttggctggttctgagaaccaggggagaggttgcgggcagcgggtctttcttgctactctgaggcagtcaccctggcctcagcctcctctgcaggcctggctgtggccaccacctaaggggctctttcctggaccctggggcccgctgggtgagctgtgctgcagaagaccccaacaaccccttgggggcacggcccactccctcctccatcccatgagctccctggtgggtgctgagtgtaaaaccagccaaatgccagggagctcagatgagaggagcccctcctgtggggtctccaagccccagggcaggcagggaggggctgagcgggggcttgccttgaggtagcactggtatgtgttgaagatgagcggcttctccacattgaacttccgctgcatctccagcgtcaggcggctgatggccggctggaagtaggtctgctcggcatccaccatcagccgcacgcccatctctgtggctttctgagaggcgcagggggtgggagagtgggagcaactgttgctcaagtgaggcaggtgccctcttctccacgagtcccaggtaccctctgcccgagcgggacagctcaccttggccaggacatccatccgctgtagcatcctggtcatctgtagctcctcctcctcagtgaaccgggacagcaggggctccagctgtcctgtctgggggtgcaacacgcggtcaggccacagcaagggcgggaaagtgccaccctgaggcccaggctaaacctctctcagtattcccagcccacaggaaccctctcacccgtctgtgcagggctgggagggagggccacctggacaagcagcacagtgcccctgaacctccaacgcagccagtgcactgccctatgcggggcctaggggtaccacgagggagctcagtgcccatgtcagtgggccccaggctcagtccaggcctgcactccgaagtgtgtactccccagttcccacagaggccccaccgttgtgggagagccccctgcaactcccatgtgacattgaacaagtgaacactgatcacccaatcgtcaaacagaagggctccacccggagcaggcagagggcccaggaggaagacccctggctacaggcagacagggcagttgtgcagcacgtgctgacacgtagccagggaccagggcaaccaccaggatgaggccttcaagttgctggtgctcagaggccgtggggacccatcccgcagggcctcccgctcacccctttgctggccccagcagccttgcctcactgggcacaaacagtaccactctatcccttgctacaccatgctaaagtctccaacagctggtggccttggtgcacagccacactgtacgcactgcgccccgaggctctgggtcgggggctctaagtttgaggctgggcccttagtggactggggctagatgtgtcatggaaagctgcctctgcaggatgttttctgaaggtgcttctgttctttctttgaatcccagtttaagctgtggtttcaagcagtctgccaggtcctgggcccccctcccacaggcagatgagtctcattcctctccccgctgtatacaggctggcctggtgacatgcttctaacaaacagaacttgccagaaaagacaccgtgtgacttctgaggcgaggcaggaaaaggtcacccagcttctgcctggctctcacgtctcaggtgacactggcccttagagcccagctgccatgttgggaaaaagcccaagccacagccagcaccaactcccagacatgtgaatgggtgcctcccccaggtcccagcgccaccactctgtgagtacagctacccaggagaccccaggggaggactgcccagctgagccctgtcaaccccagaaccatgaggcagaagcagagtggctgctgccgtttcaggcctctgaagtttggggtgacctgatgcacaagacagatgacttggggaaggcccccagaccccctctccttgtggtgtcttaaggctccgcgtgggtctctgtcccgccaagcactctgtggacactagtgggcttgtcttcttccccctggaccacagggggtctgtggggccatagtgtgcagtgattttggtcatgttaagttcccagggtaggcaacaagagacacacgtggcaggctgaattcccttcttagcgcagcgccctgctgagctgggcctcactgaggagcggaggtgttacctgtgcgttggggactaccaagtgcttggacagcttggtcctgctgtcgatgaggctgctccagtccagcaggtccatggtgctgagggaggaggcgcatcagcagagggggcacccccacctgtgggtgctagggtcgggtgggggatcgaggcccaaacctgtccgttcaccacccaccacaaaacccacctcggtgttcagttttaaaagacagaggaaatataaatattgttttctgtttaaaaatttaaaaccagtggcatgcgggggctcaaacttataatcccagcactttgggggctgcggcgggcaggtcacttgagcccaggggtttgaaaccagcctgggcaacatggtgagacctggtctctataaaaaataaattaattaaataaatttaaaaccaaaacacaaacagtcctgcatctaggcggctctgaaaacactgagtaccctaggctgttttgggcttgtggaggggccgagcacaggcagccaggcaggaggcggacacagctccgggcggccagggaggacacagtgggcaaggctggcagtgtgtgaggggatggctcactactgcaccaccccagtcacctccccacttcaactggaggctcctggtgatctgggtcccagcccctggctccaaggatggggcatggggctctgatccttcacctgccggcgtggactccagggagggctgagagtgccacctttgctctggacccagataattctataaagagccctctatggggtctgtgctggccctgtgtctcccctgcccagcccagccccagcctcagggactcctgaagccatcaagtcctgctgtgtgaaaagcagttccttcagcactgtcatcccagggcccaccctctcaggcagggcagccaggactgggagacgtcactggggcttggctggaaccatggctgatgctcgtgtcctctcagcctgggggctgctctcacccagacactcccagggtctctgccgtgaaccagtcctcaatctcagccctggatgcgatgcccaactttgcgacactttccttgagaagtgagaaggcctggatcagccccattcactcatattttatccttccccccacccattggcctctggtgctgtttctggctttattacatcgttagtaagaacaggatccatgtctggtttgtttctactgcatagacaggtctattcccaccccgctgctgatgcacgcccacgccctgcagggctgggtctccagccctcctgccagcatctcccctctctgttcagagtccctctgacctcctcctccccaccaggccaaccccagcagctgcagagtgagccacatgccctgggtgagttcccaaaaccacctccgaccactgcccaccatgccccgtgtgaccccacggtgcccaccccctcacaagccacaggagtggggaaggggaaggctgccccacctgcagcaccgccacctccagcttggtgtccatggcagccaggcccgcctgcccttgctccacagccatttggtgaaagaagcacctccacttggccagcacctctgagaactgcagctgcaaacgcaggcctgaatgccatctgcacacgcccctgcccaccccagtcccccacacagcccctgtggccagctcaggcctctaaggcatgggcacctgtgtttttggtggatgcccacagctgccctgagatctcgcacagcaccagactctgcaggtggaaggttctagcacttaccagaaactggggtctccccagtgctgtgagcttaatggctatgaagccgtcatcgctgactctacctgtcagaagccacaggaaaagccatgacagccctgagaggtgcatggaggcagcgcagggtgcgacagggagggccagggcctggccagcccacagcaggctcctgaccccaccccaccccgcccatgaagtccttgcacatggcgctctagaggccctgtggagatgggagggggctccgtggcggggtttctgtttccatgcaggtgtgggacagcagtgggcacaggagctgcctgtcccctgccaagcagcccccacaggctccctgcctcggtttccttccctgtgccaccagcaccacaggctgctcacacgtgggtcacaggacccagaaacaccgagcgtggctaagacagagacaccccagcgaggtccccttgctcaggcctctgccccagagaccgagtctctcaggaacctctgacgcaagcgcaggctcctgcccccgtgcagccagcccgcagtcccaccctgtcctccaggccagccctcctgcagcattcttgcccctgacacttctttccaagcaacaaccagaaatgttcctttaaagtgaaagcagatcttaccatctcatcttgtttcacgccaccccaatgcagggccttccccttccacctgccctgggagaacaggcaatggacgaggagaagacgcccctcaccctgatggcccagcattcagctggccactctgaccctcagcccccatcaggaggcggcttccaagcactgctcagaagtgccaggtgcagcggcatgcacctataatcccagcactttgggaggccaaagtgtaaggttcgcttgaggccaggagtttgagaccagcctgggcaacatggtgaaacaccatctctacaaaaaatatgaaaattagctgggtgtggtagtgtgtgcctgtaatcccagcactttgggaggccaaggtggagggatcacttgagcccaggagttccaggccaaccagggcaacatagtgagacctcattttttttttttttttttgagatggagtctcactctgtcgcccaggctggagtgcagtggcgcaatcttggctcactgcaacctccgcctcctggattcaagtgattctcctgtctcagcctcccaagtagctgggattacaagcgcctgctgccacgcccggctaattttttgtattttagtggagacggagtttcaccatgttgcccaggctggtcttgaactgagctcaggcaatccacccgccttggcctcccaaattgctgggattagaggcgtgagcactccagcctgggtgacagagcaagatccagtctcatttgaagcaaacaaacaaaaacataaacaggcctgggacccgctgcccctgacggagggctgctggggccagcatggggctgtgcaggtcggatgtttctaacactgaaggacattgggccttgctgacctctggcttctctatccctggaaacacctgctgcccccaccgctggcccccagaggctgtgtcagggaaggacagaagatgcggcaccagctccctgaatggaacctccaccctgggctaagtgtggctcggcagctgacatggaccaacttcctgcagctcccgatcctggccctgagccagggagaagggtggggggcatgaggcgggatcagggaacagggagctggggcaggagaggagatgccttctgggaggcagtggggcccctcaggaaggggctgaacagtgagggacccaagtgtggtcagaacccagccctctggctcctgccccagcttagtgttcacccaccggcacctccatgagcccaggggtccgctcaggctgggacatggcaggggtatagccagcaaagagggggccccacctgaggcttcgatgcagcgcaagaatgtctccatgtggctgtcgcacttggcctcattggcgtagaagtaggtgcgggcactgatgacaccattcctgcggtccccgaaggcccagtgggcctggtattgcttgtcccgcttattcgtgcctggaatagcgaatgcacggcctgagcacagctccaaacacccacccccagcacccacacaccaatagcccagggcccctgccctcaggagggctccaagcatagtggccttgccagcctggccctggcactgcactgccccatggttcccatccccaagcccaccctcctgtctacaccgcggctcttccacctggagtgctgcatccccctggctaagcctcctcatgaggccaggacggcagtctccttaacaaaggcctaggtccaccaggaggccatgaaaaaggagcagggcgtctccccagacacttgcgagtatgtcagagcccagagcgacagggcaggtgccctggacatagggaggagcccgggctccgacgtcaccccaaggcccacttgtgccccagcctagactctcctgagccaccaaggggtgtgcggagtcgggagggagtctgttcctgcgcggcagcctctcactcaccactgccatccctctccgcagctgaggtgcaggacctgtgggaaggagggggagagcaaaggtcagggtcacgccacctgagcctcaggtgacaggcacgttcccactgaggctgcacggagggccccaccacaaccccggtggagggtagattccaaggtgcagccccagccccacccctagcctggggtggaacacttgggcctgggaggggcagcagtttatggggctgctgtgtcccaagggctcaggaagcccggggctccttgtgggtggagaaatcagaacgatattcctgagctctcagaacagcccagggcttgcagcaggttctcaaataaaggtagttacctggttccaagacagagccagtcagggctgagaggaacggaggcgggaaggcaccagcacacagaggtccccaaatccccagcgaggcccccttactcaggcctccaccccagagccagggtctcccaggcagctctgatgcaagcacaggctcctgcccccgcacagccagccctgcagtcccgccctgtcctccaggccggccctcctgtagcattcttgccccgacacttcttttccaagcaacaaccagaaatgttcctttaaagtgaaagcagatcttaccatctcatcttgtttcacgccaccccacccagggttcccatcatttcctagtaatgcccaaagtcctgggcccctggcttgggcacctcaagaccagtgaggccaggatgcaggctgtcccccgctaggctggccacactctgctcagccaagcccctgtccttcctgcagaagcctctccatccccgcctggccagcacccccattccccctggcccctcccttctctagggtacctggctcccctcccccaccagccctgcacccctgccagagcctcctcttcttcctcctcctccccacagccacaatctgcttctggcacttggtttcagtgctgtgtcatccaggctagcaagagttgctgcggccgttaagtctgctgtgacaaagcgaccatggtctccctggcccccggagcagctctgagggtcacctgactttatattcaaacctgatcaagtcagtgaccacggagagagctcagctgcatgaccaacagcacccagagccttcctgaagctccccagaggcgctcggaccctcaggggcagctctgcccacactcacaggaaaggagagggtccccctcagatgccgggaaggggaaaggcagagcagtggtcagtgagccgcatcccagaggcctccatgtcaaggggcctcagctgcccactttccacctggctgctcaaggagcaagccctgggccaggagcccccgccaggaggccttccctcccacccactcctgggcagccccacatgggccagggactccacatgtgctgccagggcccctgaggctgcagcccagtgatgggagctggcaggcagatatgctctggccaccttatgctgacagagatgtgacagaagagggtggaatgtcaccatgtgactagggaacaggcaggcagcacgtgaacccctgcctgagacagggagctcctgggcccctggcttgggcacctcaagaccagtcatgagatcagccctaagaccttcacgccaaggcttaggtacagccaggaaaagccatccccaagggggactcactgtctatgttaaggccggggtggcagccagggccctgcccagggcagaaaccctcatggcaagtaacagcagacagtggggacagggcctcaggggcctccatgaccctgaagagaaggtcccatcctgaaaccacacagcccacagtttggataacacgggacttaaccacacaggtgtctgcctgtgaggcagctcaccttcatgaaacaggatcattatctgacaggtccccaggcagatgagttcccgctcagcattcccacagctgctgtgttcatcctctgaggtgggcctggcaggagaggctggggaagccagggctgctccctctcctgctctgacacactcagaggcagaacaccataggctaccgctgctcctctccgtgaacttccagagcacagaccaggctgacacagccaagcagtggccaagatgaccacacagcacgtgcagtggccagaggggcagccaggtctcagagtggatggctacgcagcaaggacagggccacactctccaacaggcatcatggataagtcacaaggagacacaaatggtggttcccaggcaggtcaggggtcctatttccactggagaagaggaagaaagcaccctgggagcagctgattcagaactgcgggtgccacacaggaaatctggctttcgccacctgggacgttgccacgtcctggctcaaggcaccacagggaagaggggggcacatggcactggcagctgtggggtgttagaggaggaagggtgaaccagtggatgtggggccctgatcagggtggggaccacatcccaatgcctccttaaagccaggacctgcctcgtgctcccccagtcccacccctcatcatgcccagggcatagtctgttgaagggcacatgatcgcacacatgggcacgacctgggacaacagaggagggaagagcgacaaggggacatagggcagaggaggacaagcacgtgtccccagggggtcttcagagacagcaggaagaccctgaccaccccctcagcctccacctcagctctgggtggctgtccctggggacgtgatgcctattgaaacaagcagagcatgggggtccacaccccgcccttgtccaactctctcctggagggaagcctggcaagccgcttcctacctgtacccccctccccagctccccaaccctctgcctccccagcccctcgctcaggacactcactgcacacatatcctgcctccagccagccctgggcctgcacagccagaccaatgcccccatccaccccctaggtgttccctcacagcccaatcatcaggaagatgccttggccccttccccatccccaagccctcagcctgcttcggggatccctgggactcctctcctggggttgggtggggccctggcctctgggaagcatggtccaccccccccccgggtgggcattgccctcctgcacctccaggctcccacctcctctttctttctcgggagcactgctgggactcactttgccatgcactcagacgcctccatcctccctgggcctctcacggccagcaccacttgccatggccttaatttggggcggtggcctcagtgtctctccccagagtagagcccatggcccttgtgacaggagggtaggttaggaaggcagatctctaagcagttccctgcactagggtctgcgtgactggtcactcctggccaagcaggccatgctgcagtgtggacatcagaccagtgcttgcagacccagccctacccccatggctcaggcccctctgaaagcacaaagcagctgagctcggtaggtgtcctcagcatgcacccctgtgaggacaggagggaaccctgttcacttcccagagctggagcaggacccctgcagacagcagccaccagcagcaagacaggtgaatcccttgcagggcaaaggactcaagctcctaaggacacaggtgcccagccccctggcagagtgcaggccagtccacctccagacactcagcctgcagggcagggaggaagccaggcaggaccaccctgggaaaggagtcttttcataccagaggcgcctgagaggaaaatcccattgtgaaaccaagtccccacccagactccttctgagaacacacaggccattggttattcaacaggcagctcagcaaaggctgcagccaagagctcaggcagctgcaaggcccacggggcctgctaggaacacagtggggtgctggggctgtagtaccccaccttcaaaacagccaatcgcaaggcaggggctgggctcccctggccaatcctctccaggcagctggcagccgacatgctgaggcaagcctcagacattccgttcccagggctggaggcctcatgtgactgcctttccctccccttcccaggccagccaccaggggaggggcaggaacaaccaccaaggcctgaccaggtccacagagggactgtcccaagccttatgtgggtcaggcccggctgctgtcagggtgcaggggacccaaatacataggaagacatagggagatcccatctttacaaaaaaaaattaaaacttagccaggtatggtggtgcgtgcctgtggtcccagctacttagggggctcagatgggaggatcacttgagcccagaaggttggctgcagtgaacaatggcaccactgcactctagcctgggcaacagagcaagaccctactttaaaaaaactggttgaaagaaatcaaaacaagaataatattttgtgacacaagaaaattatatgaaattctaattactatggccctactgaggcagagtgaagccgttgtggcagggagggtgtggcccgactgagagtctgtgctacctggctgtttacacaaacttgctgacctgatggaggaggctctgctacagcctctcttttgcagggattcctgacccgcaggcaggtcccactgcccgacccttgcctggcctcagcctgccctgcagttgtggaacctcccaggcctggcccctgccccattgtcagtggagaagggaattgaagccaggagcagtgtagcaggccggcctggagtcagctcctggaggccactaagctgatacaaggccccttccctgggcagtgagtgtagagggcagttggtaccaccctgacccgccctcctgggcagggcatcaggacagaacaacaagaccacgtttccctccacttcctggagcagtccctggctcatgtgagatccaggcgagaccaaccattctttgcagagtgcttggttcatatgctggtgcctgtgctcctccaggcggtggactagatagggccaagggccattctgtactctgcttcctcaggcctcacgcacaccaggcctcccatgaaagcccagagctgtccaccgcatgaaacaaaaatgcaagaactccaggcagagcccaggagggtcatcggtagttgggctgaccaagctctcctagccttggcctctgcccagctgaggctgaagcccagcagctggatacatcccacctgctcccactgggtgctccagggtcatgatcagaaagcccgcagacaccgggcaggccttactccatctccttgtgctctgcctcctcggggctcaggtcctcctccactccatagtccaggatggcgctgacaccgaaggccctgtagtgccgaagcaggggctggatggactcctggtcctccccggctacaaaatgcccatagaaggtcatcttcatgagcttgttgaatagcctctgtcctagaagtttcctggaaacatacagcagctgaaaggcaaagggaagccgctgtcctgggctgcctgaactctcctttcccagcaaggcaccgctgctcatccccgaccacacttcaccccagccatggggcctcgatatggtctcttggcgactgggctttcagggtcagtttcatggtgaagaccagctaaagccgcttgcttctccaccctgtccatcactccagttcccatccagggcagagagaccacaggaggtgctgcctgcttggcctgaggacactgttcccacctggactctgccccttcagggccccacccatgagtcactccagcagcacacagtgggtgcctgaccactgcttggtggataaaaaggagaatggccagcctccctggggatgacagccggcattttgagaccatcctctgtatccacaccttggtagttctgctgcggaagaggaggatctaacttgactttctagtacttgagtgcccagatttttcaatgttttgttccctcttatcccaagtcccttaaacagtgtgactggcatgaggccagcccccgaatggatgctaaataacaaacgtgtgaaactcaggctgagtctgcgcccagctggagggaggcatgccctggcaacaaggacaatgagctagatgacagtccacaggggcctgtgagatgactcccaccccaggacccatgcgctctgcagggtcatctggggctgaccagccactctgacagatgctgcccgggaactgtctgtctcctccaatcatatttcaccacgtcgctcattcagatgtcccaagctgccatgcaccaagcaccttttatagactggaaacaaccaaaggaaaccgaccaggatctcacatcctggtggtaaaggaaccccaaaggggaaggagggactctgcctatgactcaggacagggggatggggcagtgcctgcagggtagggcaggggtgtttactaacccagatccaggagtggggcttgccaaggcgaggagatggcatggacaactgtgggagctccagcacgggggacagccagggcagaaaggacagggacaacgagaggctacttggagaggagggccgagtgtgatgctcagaagcacacctccgcgttgtgtctgctgcccctgccgactcagccccaacacaggaagagcctggggtttctcaaacccaatggatactagaactccttttatgtggggagcatctcttgagaccgtagtttcaggaacaacttctagtctaagcaaaaccattagcgagtcaaacacttacacccaagccagccctgagcacccacacgcctgcccacaggcagacatagccccacagccttaccctgaacattggtgccccatggagacgcctcctgaccatcacccctgggcacgccatggggcagccccaaggaccagggtttcccaggcactcacccctgccttcctgcagcctccaagcagaatctgactttaaggcattttgttcttttatcaagaggattagaaactggaaaatgaacaggctgacatgttctccgtctcccactgagcctgagccaggcctcattcctgctggcagcacccagggatagttgggagaacaggatgggtctgaaacatatcaaagatcacccaagtggcaggcggggcagaactggggacctgaacaccatcactgggcttatccacatccgctctgagagaaccatcagaaaacaacaggagggagggtgggcaactgtcgactgccgcacggggccacgcagtctccctctacctaactgctcgcctccgcacggccagcactaaatgaaggggcgggagcccaggctgcactgactccagggatgcttattcacaaagatggggggctgggggactgggcccgggctgagggtggaagctccctgcacagggctgcagaagcacacaggcagggctggcaagttttttatttatttatttttagaggcagggtctcactcctgggctcaagcgacactcctatctcggcctccagagtagttgggactacaggcatgcaccaccacactcagctaacttttattttttcttttttttgaggcagagttttgctcttgttgcccaggctggagtgcagtagcacaatctcggctcactgcaacctccacctcccaggttcaagcgattctcccgcctcagcctcccaagtagcagagattacaggcgcacaccaccatgcccagctaatttttatatttttagtagagatggggtttctccatgttggccaggctggtctcaaactcctgacttcaggtgatccacccgcctcggccacccaaagtgctgggatgacaggcatgagccaccgcacctggccccagctaacttttaaaaatattttgtagagacagggtttcacgatgttgctcaggctggtcttgaactcctagccttaaatgatcctcctgccttgacctccttaagtgctagaattacaggcatgagccaccatgcctaggcatgagcctagggcttgtaattttaaagctgactccacagcaaagcaaccactttaacaccatcctggtgtcactgatgtccccgcatggcactacctgagaccagggcagccccacatcttcttcaggtgaggagatccttcgaggatttagaaacctgcaccagtaacacatacacttgtaccccctgtgaaagactcaaccaaatgtgtgcagagtaacactggtagagccggttctctcccctccccccactcagggaaccactgtcaccacgggtcctgtcccttctgtgagggcgcacacccaacctcagtgctgttgtcatggaaatcctgggactttcctaaaccctcctcaataagtctggctttcaggcaagggcgggccccactgctgtccccatccaaggcagcagctcaaagatcagctactacaacctgacacgcctgtggcagatgtggcctcactgcccgggtgcctcacagacctgtgctggctcagcagaaggaatctccccacagcccagagggtgagggaaggaactcccctctggcccgctcacaggaccaggttctagtgagcagctcacaagcccaggacctggcctctgccttcttccagtgctgaggctgccgacacccatgggaccactagcaagacaacagtacagaccccactgagggacttcccagggcacaggtgggaccctaggggagcctgggagaggtcacctctggatgccctgcctcttccaggtactcacagcaccatccctgagccctggcacttgcctcaagaaggcacccaagggacagcggagccaacagtttcctcccacagtcacggaacagcacctggcattccccgcagcagactgggcaccaaaccccacacccagctctgctggcttctctgtgcaacaacttgtcttgaatctagacaagaaaccttagggctgtgcctacagaaacctgacctggtgccttcctagccccctccccatcccagccatgcttagggctgtgcctacagaaacctgacctggtgccttcctagtccccactccatcccggccacaaggtgggcatggcttctgcacgactggccccagctgccacctagcatgcccgtccttgccctgggcagggacctgtggctggccactccctcccctggcatttctgccctgctgcctcctcctcctattgcagcaccaccagcactggctcctcttttgggatgccccttagatgtgggcactccccaaagcctccacatcgccgtccctcaccttgccagttcctctacctgggatgtcccttctcgccctcctgtctccttggccggggctctctatgaccaaaacttgaccttaagacatccttgtgtgcacacacagcaatgccctcccagagccctccatctgtccagttcagctccttcttcctccaccatcctccgcactcccgccaccacgggtcctaggctgaccttggcgctccccatgggattcgggccaacagcatctgactctgagttcgtggatccctgccctcacctcgcacccgccgaggcctcacctaagctcaactgtggctcggtgcttctcatctgacaccgtcccccgccttcccccgcctcctgttgaggccaggggtgcagcccccgacctctgtacagtctcacctgagaaatcaacaccaccagataccctggcgccaaaaagcggaaccttgcaaactcttcccagggtcacctggagataaccgtcatctctagtacccctaggctgatgcggctaaaacagtgttctgcttgttgccccccaccaccgccaccaaaagccctgacactttttaaagctaccatgggtgagttcaaagctgggcgtttgaggggcttcccatttttccccaacagtgttctcagagtggccgtgtctgggaagctgctgggtcccggggtttgaattccggggttccaggctatgagccctacaccaggattctcttgtctcaacatgaagaatactccattttaaattccaagtgataactctgtattcccacaagtggtatatatcgtaaatatgaaaacgaccattgtttttagttggtagacatcgacaaataggaaaatttgcgaggtccgagagggactgcaggaaacgcctcccttcctggcttcccttgctccaggagatgcttgggaggcacccgtttcaggccaggaagctccgtaaaggctcccgggaccggcagaagcccccgcgcccccgcctgcaccccgcgcacctgctcgtggcgcgccagcagcgcgggccaggcgcacaagcgcagcaccagcaggctccgcgccagctcccaggttcgccggctgcggtacgcctcctgcgcgttgccgaagtccacggcgggcaccggcggccgcactgccgtggccgacccacctcctggcacggccgctgggcccgctgcgggctgctcgcgggaggccggcgccgtggacagcgggacgaagcggggaatgcaggggcgcagcgcgggcagggcgcgcctcagagccatggcgggacggcggtacccgcccgggccgcttaagtgtgcgctgttggtcccgccccgccccgccccgccccgccccgccccgctcggtcccagaggcctcaccctatattcctgacaaatgccagacaagggcttagacttcacaagcaccctggcacttcagctgcatggtggggaccctctgccggcagggctgaggccaaggcccactggcttctcaaagcctctgctcctgctctccgtgaagacagcaacagagtgagaccctgtctcaaaacaaaaattatgtattttcagatagcttgaaggagaatattgagtgttcgtaatgcaaagaaataataaatgtttgagatgataggtatgctaattacccttatctgatcactatacacgtacagaaacatcactacgtaccccacaaatatgtacaattattatgtgtcaactaaaaaataaaaatagccgggtgtggtggctcacgcctgtaatctcagcactttgggaggccgaggcaggaggatcttttgagcccaggagtgccagagcagtctgggcaacatagtaagacctcgtctctacaaaaaatagaaaattaaccaggcatagtgttgcatgtctgtaatcccagctactcaggaggctgaggtgaggggattgcttgagcccaggaggttgaagctgcagtgagctgattgtgccactgaactccagcctgggcaatggagggagaccctgtctcaaaaataaaagtgaattttttttttttgagatggagtcttgctctgtctcccaggctggagtgcagtggcatgatctcagctcactgcaacctctgcctcccgggttcacgccattctcccacctcagcctccagagtagctgggactacaggcgcctgccaagcctggctaattttttatgtttttagtagagacggggtttcaccgtgttagccaggatggtcttgatctcctgaccttgtgatccgcccgcctccgcctcccagagtgctgggattacaggcgtgagccaccacgcccggtgaatttttttttttaaagaaagattccggacacaaacggccacaagttgtatggttcgttttatatgaagagttcagaatagacaaatcgatagagacagaagtcacacgaagacaagcccatagtggagcctggtgagtatggcactggcagtggtgcctggaggtggaggacgggaggagtgggaggggctgccaaggcccacggagtttctttggggtccggaaatactctggggctagagagtggtgatgtttgctcaaccttgtgtatagactaaaaaaccattcaatatctcaataaagctgttatatttttttaaaaaagcaaagttctagcatttgcttcaaggaagcctgtggccctgcacagaggcaaaggtgggcaggggctgccaggggcagggctgcagagagggcagggggagaagcgaggggtgcagggatcacagagatcaccactcacgtccagaccatagcagagcaggcctagcgctgggtgcccaggcccacgggagagcccacctgtgagggcacctgtgggaacaaggctggcctgaaagtcactggctccatgtgacaatcaatgaaacaaccgagtttcacaggagctctgtaaatcctaggaagcaggtcttaggctcagctggggacccttggcaggtggctaccctgagccagctgatggctttttttttttttttttttaagagacagggtctctctctgttgcccaagctggagtgcagccatgtgatcacagctcactgtggccttgaactcctggtgtctcatgtgtccctgtgaagggaccaccaaccagctttgtatgagcaacaaggctgtttatttcacctgggtgcaggcaggctgagtccaaaaaaggagtcagcaaagggtggtgggattatcattagttcttacaggttttgggataggcagtggagttaagagcaatgttctgggggcaggggtggatctcacaaagtaccttctcaagggtggggagaattaccaagaaccttcttaagggtgggggagattatgaagtacattgatcagttagggtggggcagaaacaaatcacaatggtggaatgtcatcagttaaggctattttcacttcttctgtggatcttcagttgcttcagcccatctggatgtatccgtgcaggtcacaagggatatgatggcttagcttgggctcagaggcctgacacctgggctcaagtgatccccctgcctcaacctcccaagtagctgggactacaggctggactgcacctagctaatttttaaaaaatatttttttgtggagacagggtctggctgtgttacccagtgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaagcagatgcttgaaggcagcctgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggagaattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacatctggtgcccaacatggaggcttttctctagggtgaaggtacgctcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggacaagtcctcttccagcaggtcaggtgcccgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtgcctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccctgccacaagcagcagtgcagcagtagatttatgtactatacaagcagtctctctgcttccaggggagcccccacaaaaaatccccacaggggtatatggccccctgcctgaggggactgtaggactaatcttaggaagatcaagtctaaatctaaaaggagttcaaattcatactagtgtggttgattcagactataaaggcgaaattcagttggttattagctcttcaattccttggagtgccagtccaggagacaggagtgctcaattattactcctgccatatattaagggtggaaatagtgaactaaaaaaaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggttgagatttattacaacaatggggtgcggaaatcaccatgcccgctccattatatagccccacgagtcaaaaaatcatgaccaagatgggatatataccaggaaagggactagggaaaaatgaagatggcattaaaattccatttgaggctaaaataaatcaaaaaagagaaggaatagggtatcctttttaggggcggccactatagagcctcctaaacccataccattaacttggaaaacagaaaaaccggtgtgggtaaatcagtggccgctaccaaaacaaaaactggaggctttacatttattagtaaatgaacagttagaaaagggtcatattgagccttcgttctcaccttggaattctcctgtgtttgtaattcagaagaaatcaggcaaatggcgtatgttaactgacttaagggccgtaaacgccttaattcaacccatggggcctctccaacccgggttgccctctccggccataatcccaaaagattagcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaatagaaataagaaaagatacattaaaaacactaaatgattttcaaaaattactaggagatattaattggattcggccaactctaggcattcctacttatgccatgtcaaatttgttctctatcttaagaggagactcagacttaaatagtaaaagaatattaaccccagaggcaacaaaagaaattaaattagtggaagaaaaaattcagtcagcgcaaataaatagaatagatcccttagccccactccagcttttgatttttgccactgcacattctccaacaggcatcattattcaaaatactgatcttgtggagtggtcattccttcctcacagtacagttaagacttttacattgtacttggatcaaatggctacattaatcggtcagacaagattacgaataataaaattatgtggaaatgaccaagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaataaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcctatgtagtacaggctacaagggatgttgagacggctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccgcggagatggtaacaccagtcacatggatggataatcctatagaagtatatgttaatgatagcgaatgggtacctggccccacagatgatcgctgccctgccaaacctgaggaagaagggatgatgataaatatttccattgggtatcgttatcctcctatttgcttagggacagcaccaggatgtttaatgcctgcagtccaaaattggttggtagaagtacctattgtcagtcccatcagtagattcacttatcacatggtaagcgggatgtcactcaggccacgggtaaattatttacaagactttccttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcatgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaactgtagattgcttacttgcattgattcaacttttaattggcaacaccgtattctgctggtgagagcaagagagggcgtgtggatccttgtgtccatggaccgaccgtgggaggcctcaccatccgtccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacaccaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaagtgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacaacccaggttgatctgaaactcctgggctcaagcaatcctcctaccttggcctctcagagtgctgggattcaggcatgagccactgcgcccagtcatggattattttgaaagaatgatgccctgccagggccagaggatccaggtgggagttggcggtgggggggtcctcagggagatcggctggatgggagttgagtgccggggacagaggggtggggtctgttctccagctcaggagacaggcagagctgagagggccagacttgggcatgtggtggtgacccagctgctgggcgcccccgaggttgggccggtcaccagggcctgccactcccaaggaggaagcagacaagaaacagaccttcgagggtagagaggccgctgtgctgcctgtccgggcccctgcggacatgcagtcagccccgctcaggactccttccattctcccacttgcactcattcccagcgagataattgtttctcctcagccatgagcatgacattggagctctggcaaagtcaggtttttttgttgtcttttttgccatgtgcctcttacctgtactcctgaaatatttgtttctgtgctggaaccatggctccctgcattcattctgatttgttgcatttttgctgcttgccctgtagctacttttaccaatacatttgctctgtctgcaggcaaaggaattcattcacatttgtttaatttggagcttgtctttcctttatcagcctgcaccaaacctgggctgctgggtatataaatttccctcatcggtacgttatcccattatccacttcatgctgccgttcacagatcctacttgagttctgttcagctatgtcattttattcattttttgcaaagctagtaaaatgtgattgcatttcctgaagttaagattgtctgctggatcccagaacacgccactgtttatgtgaatgcaatcacacttcaccactttatataatcattttcaatgcgtgtatgagaaaaggtagttagatccccccacccctgctagattgtttcctgctgagaccagcttagtcggggagaccctaacacggtggcgctagaataattaaagacacacacacacagaaatacagaggtgtggagtgggaaatcaggggtctcacagccttcagagctgagagcctcaaacagagatttacccacatatttattgacagcaagccagtgataaacattgtttctttcttttttttttttgagacagagtctcgctctattgcccaggctggtgtgcagtgggacaatctccacttactgcaagctctgcctcccgggttcacctgcctcagcctcccaagtggctgggactacaggcgcccgccaccacacccggctaattttttgtatttttagtagagacggggtttcaccatgttagccaggatggtctagatctcctgaccttgtgatccgcccgcctcggcctcccaaagtgctgggattacaggcgtgagccactgcacctggcgtgtttttatccattttaatgggttactagctgctaatctgtctgcagctccttcaagcactccagttcctggcattaaggtcagatgttcctgggatgctttaaatatttgttcttttaattttgcacatccaaagacaaatttgtagagggcccttctagatgcttttttattctttcccaaattttgatcttattaagaactgttaatagtttccacaaatccttatgtgaagctcctagagcgggccatatcatttgagattgaggtgccactatactgccatggttccagataatgggaacttttgccatacttcttatcatttctaccacctgaccatttgttcagaccagctgaacatagggtggccgtggcatgcagactgagaggtgcaattcaagctaaacatccccttaggggaccaatcaataatgattccataggaatcgctgcgcagcacctctgcctgttctgcaatgcaatcttcctaaacaagtacgttcattatttctggccaggttctattttgtttacaaataggtttttgaaggcagtatgcctcaattataggagcagatttattatggtaaatactgagatcagaaagcatgtgtaaatacgtcatagagtgattactttcaggcattattaccagtcaagattgataaatatgccctgtaagtataattgttctctgtgtcagaccttgttgaaggaatactcacggcagtggtgataaccgatatcatagctaccagtaaattactcattgtgactggttgtccctctttcctcaggttttcttctgccatctgtgacagcttcttgatctgtccccaggtgggtggctgtgttcaatgggtgttgcttgtgacagttggctggtgtgagatgtgtttcagccccaggtctcagccagtggtcgcccagtggcacagtcagagccgggcctgcctggttccctgggctggcactctgagtccaaggtggcacggttgggcagcgacccctccctgagcccccaacctctgacctcctaggcactggcctgagccgtggcttctgaaaaggaaaacctgggaattccttcaatgtccaccttaggtgatgatgggctcagggcaccatggggtgtgcccaagatgatgagcccctccctgcatgtcagtaacagggacacacatctctgatgcgcggggagggaagagtctgagtgtgtgaagctgtctgtccatgcaggccacatgtggatggggggcaaggacatggaatggaggaagacaggactcaatgtttttgcatcgaccgctcttgtataagagcggtctttacaaagtaataatgccttgagttaaccccacagtttatcttgtaatgtggaacagtcagggccaattgaagatgagcatccccctgaggctgactcatagccgggccgctggagccaggcccttcggggtatttgagatttctttagccaggcctggggggcactggcagggagtgcctccagagctgttcacggcctttgtctcccctctgggaagggcactgagtggagtcaggtgaggggcccgtgctcgcccaccagggttgttccaaacacaggcagcagggctccctggcaagctcccgggtgccctgtgagcagctctgacgtcggtggacagtgttcccagtgagtctgccgtcagtccttgtgcccagcattgattttccttccgcggtcaagctaggctgtgttgttggtactcgctgtacctccaggtgctgagcaagctgaccttggcctccctggccccacggctgcatgaggctaatctccccctacacaccccacccctctgcccccgccaacaccagggcacagaggggctggcccatggctttcttgaaacggtgcatttcacttctgattataaaactaaggcgtgctttggtagacagcgtggtggatatggggaaggataaaaggacatcaacctgttctgacatcccagcacccagggcagggacccagaggggagatttgggtgtatttctctccgttgtcttctctgcaggcatgacacaggtgtgcacacactcatccagcccactgacgtgtgcacaagcatgaacacatgtgggacacttgccctgcgctgcagtgtgtgtgagtcatgtgcacgtccactgccctctgtggaaggcgtgttcacacctgtgcacatacctgaggccgctctatcactgcaggcccctgtgcatttcctgggaggtatgttcccatttcattaagaattctcggccgggcgctgtggttcacacctgtaatcccagcactttgggaggccgaggcgggtggatcacgaggtcaggagatcaagaccatcctggccaacatggtgaaaccccgtctctactaaacatacaaaaattagccgggcgtggtggtgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaaagaaaaagaaaaagaaaaagaattctcagtgatggatctactccaggccctgcctcaccatcactagccacagagctactcacagccagtgctctcctcacaggggtctgaatggcaaggagtgagccgcaggatgacccaggacaagtggcagcaacagggtgagttcccaggatgctggacaggctgtgtgcagctcccggttctcagcgggtacagagatcccagggaaagccgtgagatgactcctgcacttgtcctgccagcaacctgcaggggtgggtgggatcaagagtgacagaaaccgcaggcaccaggcatccccccaaaagagcaagggggctctgggtgatgtcctggaggggcaggagcaaggagggaggccaggggcaccgagggcatctcatcacatgggctctgtcccagccacagtgctgtctctcccagagccctgtgtagcctcctgcccataggtgaagacccagcctcagctccctgcacgcagcaggcccacccatccatccatctgttcacaccaggaagcccagaggcaggtggatggcctctgtcctggcagtgcaacattgctggaagcatcctccaagagtcacccatccccacagacactgatggaggacagcaatgatgcttcctgacagcaaccaccattcactgagcattcagcaggggtgggtgtcagggtcagcctccaccacgtcactgtgggaacagcccccaggacccgctaactcattttatacatcaggaggaaagccagggagcacggtacactctccagctaccgtggggccagcacactgtccagccaccttgggccagtgaaacggaaaaagttcccttgttgccctagcagtgtgtgtgagaaggggagtggctcgcttcttcagtgctccactgcccaaacctctaggggagcttacagacgggcaggctgtggagctccgaccccacagcagtgtctaggggtgaaggtttacagctgaagccccagtgggcgtgtgtcacgggggcttttttagtttgtcgtctgtagggtggcttgtgttagtcagagggctttctggatcctggggttcttgcctttgtgtaccagaagagtcagatcacacgtggacttggagaatgagtgcaaggttttattgaggggaggtggctcccagcagataggggaagctagaagggggtggagtgggaaggttttcccctggagtggggccgctgtgcacccgggctgtcctccaactgccccagccaaactccgcgtggttctgccagtcagtggcctgccagcatgccggtgcctatcagtgcgttcatctcgacatccagccgcccgtgtgtgtctccgctgatgtgctcctctccacgtccagctgcctgtgtctgcctgctaaggtctcaggggattttataagcacaggatgggggcgtggcaggccagggtggtcgtgagaaatgcaacatttgggtaggaagtgcctgttctcacctaggtccgtggggttggagccctagtctgggaccatgccctcctctacccagcacttcctttccctgcttccgtatcatttaaatggaccacacttttcccttcccagcacttgccttccctatcaacagcacattctctagccaccatggggtcagcacactctccagctacgtcgggccagcagcggctgggctccaactcaggtctgcaccagaccctcattcttaaacccctgcgtctcggcctgcccatgttccagcttccccaagtcttgactcccaatgtcccagcctccttgaggtctcagtctccctgttccaggcctcagcctcccctgagtccctgcctagcccagttcctacctcccacttcccctccccaggtctctgctaccatggcccacccagctgcacccccaccccacacttctcctgggacccaggaggccactcatgggctaagcctggtggcatcttcatgtaaaccttgccctgagcacacgcccgtggctgtggctgctgactttcactgtgcatattaaatgccattaagatggttgcgattggttttcagtgtccagaggactgcagcacacggagaaacagccgccctgcagggcctctccccgagctctggcgggtgagcccttgtgggaggggctggggagctgggacccatttagggtgtggttgggggagaaggcaggaggcaggtgggacctcccccggaacctctcctgagacaccctaagggctgggaatgggagctacttggtgggggaacccagcaggggtttcctgtccccgggctctggccatgacgaggaccctcctgctgttgcctctcccaaggccactcggcccctgctcactgtgcaaccttacagagcagctcagcctctctgagcccctctgtcatctttagccactgcccaccagagtccccttggagctgctggccaaggcaaggctgggcaggggcttgacataggctctcacgccttcagatgccctcaaatgggattcaaccccgtcttggctcctgagacctcccagcctggggtctgagggtctgtccagatctgcaggtagatggctgggcctgcagggacagaggcggccggcggagggcagcagagggccgcagaactgagcggccggcactcaccaggccgggatgtggccaccctgcatgcaagcagccctgcctctgccctgggtcttgtcccaccccccaggacacccaggccctggcttggctgcggcagggaggccaggcctcacccctctccctcctgacacctgcccagccactggcttgggccgccgccctccaggcctctcctgccacccaccccagcaccaggccccctgatgcccctgcttccctcccaagggtccctcctagacaccatcctggcccagccaagatgccagcacaggatctccccaaaacactctgggccctggaggacagggtgaggctccggcaccttccaggtggcactcatgatggacaatctcaggggccacacaccctggacccacctcccccagtgcagagacccccacggcaggctctcagccgtgaatatggacacacaaggctcccgggacatgggcaaagggttgacactggctcatagtgtgggcaccatgtcacagggcgagacggagactcagcccccagggtagcggccagtgctgaccttgggctaggccagggcctggccatgctgaaccaggtctgagcatcctcaggggccagcctctccctgtggggtccccacaaaggtggccatgggctgtcctctgatgacaggaagccccccttcccgtcagccccgtctgtcagctccctctgccctggggtgaggcctctatggtgaggcccatggtcctggctccaacctcgcactcctcgggacccactcccatgcccggctccctgccagacccacacacccaacccagctaacaccagccccaccctgtcctgccccacgggggcagtgccctccactctccttcactggtcccctctccgtcctcctctcacccactcttaagaaacctcccacacatgagcacccgtccgtccccacacctgctcaccaggcctggctgggcctgaccctctcctgaagtgagggctgcagcctggtcggctcagctcatcagcacagacttgtttctgtcacaacagctgatgaggactgagcagatcatgggctagccaggtctccatggcctgccccaggcaccgtgatgttccaggatggtaaaatgagggaggaggtccaggtggctgacagctggctgaggcagaatgcgctgattggcgctgcccagaggggaggtggacccctgggctaagggagctccaaggaacagagctgaacccaccactaacaaaagatgggccagagccagcaccgtatgccacagcacgcagaacaaaggcctcgtgccctgtgcccagctggccgtgtgtcccctccaggcccgtcactgggcttcctgaccgcctcatctccactgtctctggtagccaccctcattgtacccttctccatggtgccctctgaatgaggccaccatgtccgaggggacatggatgactccagctggcatggccttgcccatcccttggggctgcagcacagtggccaccctctcctcactgctgggaatgttctggagctgagttggtgcagggagggtgaagaggccccgagccctccacacacccacctctggcagcagttagcagcagctggggagagaagggtgtgagctcttgcagacatggcaccccagggtatcctgtgccaggggacactttggccatgaaggaactgtcggggcatggcaagctctggggggcatcgagggtgcactgacagcacttgtaggggagcggggtcccagtctcagcactgtccagtcagacaggcctggcctgagttccaactgcctctcccagctgtttgaccccaaacatcatggttttctggcctctggaacggtgctggagagggatgaaagcatcaccgggggtgcaggaggaaccacaaagtcctgtggaagttcatggcagctgtgagcctttcattctgagtatctgagaccccaggaggggctgggcgctcgtctgggctgatgtctcacagtgaggggcggcggccccagccaggatgcaccattcattgccattgatgaggtctgggaagagaggtggtttgggggacatcatacggggtccctgggccggagggtcccatctttggaacagaggggccgggggccattccagaacagtgtccaggagagaatgggctctaagccgaccacccagccccctcctgccatgtggggctctgtgctgagtgcatggccccccagccccccgcctgtttgatggcttctcccctcccctctctgctgcctggtcccctggagctctcccttccccagcatggggctcagttaaagaaaaaactgattcctgcagatgaggggaggaacagccctgctggaggcaaggtgggcgtggggggagcttgtctcccctgatgcgcaggcagtggctggcggagcgtcttcgggggtgggggatgaaagctcagactctggcctgtgggttccagctctaggcttcccaaccaccaggctccccaaaaggtctgtagtgtcctgggcacccaggccccgatctcgggggcagggggcacagtgcctcccacaagcggctctcggcccagcctcagggctcctcacgcacacccagggcctctggagtgggcaactcctgcaccctccacttccctcagctcaaaaccagggcaggttcgaaacgcgcgtgcagctcatcataaacacgggtttggaatttctaacgcggtgcctccaatttcacaaaatattgccccactttagacattctcaaggaaaggaaatgggggctgggagggcccagggcctgtggagggtggggctgggggaagcagccatgggaccctttccctgctgctttcaatctggctcagatattttttagatgaaataaaatctgattcagtggtggtttctgcactgcccccagggtctggggtcagaattcccccgctggggcacaataggtgccatttcccatgtttgggggctcagggaacagggtgtaagccatgaggggaggggcttgggaaggtggggatgggctgctggaggccgtgggccggcgtcttggtgtggcagcctccaccacggcaggcaggtcatttgatgcccaaggcccagggccccctgtccaaggtgaggagctgtggctgggtctctggggaggccaggctgcctgcagtggaccggctataccctggagccccgcgctaatgcccatcctcagatgctcccagctccggcttgcctcagggccttggcactggtgacccctcccggtctcctgcactgtcttcagagcctatggcagcagccccacctgagttccagctctgcagtctgctttgggccacatttcctcactgcaggcccagctggctctcagcatggtatctgcccgggtgcccacatcacagagactggggtatggaggatggcaggctcccagggaccctctgggccgatctccaggttgggtgcatgctggacactcactccattctgccctccatttgcccatgctccgtccacccagccgggcccggagggtcaggggtgtgtgggcaggtgctgctcagaggccctggctatggggcagggggcccagcctcaagactgcggcctggccctgagcgtgggcgcagcctggctccccgactctccctccccataaataaaagattcccttcctccttccagcttgcgcagccgccgcctgctcgccggcccggccctttgtgcccacgcgttgccatggagatgggcgattcaaagtcctggcacttcaaggcttccctcctctcctggtgggccggggcgggggtagccgggatggttgcccgagccccagtgggtgccgcctcctctctctgtccagtaaaatgccagatcctgccggggctagggcacccaccaattctcactctggtgtgggtggctgactctggcccctaccctgaaaacagatgcgcttttacagggaccttcttcaaagtttgatagaataagggaaactgaggcacagctggtcccttggccaccgtggggaacacagagccgaccccctgtatcatgcaccatttgcacagtgggctgctttcagctgtgtgctggccagggtcatcaggctccaggacgtggccctgcggagaggctgcccttcctccatcccagcatggacggcccagggctggaagccgggatttggggtgagctgcacggggatgactaatccagccacaaagccgtcccctccacactctgcccgccatgcgggttggagctatctctgagtcaccgtggagacgttgagaatgtcgcagggtctttgaggctcttccgctccccccaatcctgttccccactcatactttttatctccccacaatctgccctttgatcatctcctaagactcatgcaaccagcagaattgacggcagcactttctggttcagccactgcctcccacctaccccactgcggcagccacttggtatttgttgcctgctcactgtggcagccaggcaagtctgggaccccttagagcctcggtttcctctcctgtgtaatggaagcagtcgtccactcttaacaaatgtccagagatgtctgggggccaggtctctgtgctgggcctgggaacaagacacctgattttgggggagattctgtcccccttgctccaccccatgaactctggtgagggtgaccaccacacaccacagttacttccgggccccaagtggctggcccatcagggacttcccgggagtcacaggttggagggaaggaagccagggagaggtggcagagctggctgcaccccaaggctgtctccaaggggcccacccttggcctccatccacccctccctggcccggacccctgtcctgcctcagcagcccagcccacggcagctgtcccctcacaggctacaaagatggtggccctggtcctggccgtggagcaggcaaggcacgtggaacataaagaaatatggttgtgaagtggccaggccatggaggaagctcgggggacctcgatgtctacattaagacctcccaggagtgggttgtcccttctggaagggtgctggggacagccgtgtggcccttttcagtggaaggatcccacatcctcaggcagtgccatcacatcccctgagaagccctgaaacccaggcatgaggatgcagctggcccggtcccggcagggaagggagtgcagcagctgggctccggctcgcctacccactgattgccagtgtcctgggtgagaaagcaggaggcttttgtgcacacatgggcctcgggactgggtcagggctcaggctccccagacgggagaaagtgcatgcagggccaccggctccccagctgaggctgagggaggtgtccttgccttccgtgctcggagccctgtctcaggtgcttggcgctcttctctgcatcttgggtttccagcaggcctgccccgccccaggacttgtggggaggctgggactgaccgcgatcccccaggaacaaggcagatgattgatagaactgggccccgcctgctctctcagcccccagagcccccagaggtgagctccagatgtcaccagggctaatttgggagcccctgccccatagaggaaaccccctgcaccaggcagagccccgcttggcccctgcttcagccgagggctgcggcccatgctgccacctcccctgccctgcagcggagctagatgatggctgttctgtcaagggggccctcggcctagagcatcagtgccactcggccaggactagctcaggtggtagtttggggctttgaccctggcctgtctgatctgcaggccgagcatcccccaccacactgttttctacaggatggaatggaaaggaagccagagaccgggagacccagccacagccatgcaggagagggctggtcagggctgaggctgctgcccctgacctgagagcaacggcaccatgcccctccatctgccatctgcacacagggtcgcctccagcccacagggcaagggggccagggctgggtcctgagtgcaggggtgtccttggcagggtaagagtcagcctaactcaaactccactgccacactttgcagtgagactgacaggtggaataaacccaccaggcccctcagcaccagtaagagctcttcagagtggcccaggcctggccatgtccctgagagaggggtgctgctggcgcgccctgagcagggggtgggctgggccctactgcttggttctatctcagatttttgctaataagcccgtcttttttcttttttttttttaataaacttttcaactttagaacagttttatctttgctgaaaaattgagaagacagtacagagagatcgcatctaccacacaccagtttcaccgttgtgagcatctggcattggtaggttagagttgctgagccaatagcggcacactattatcagccatcgtccatgcagtgttcacatttccttcgtccttaccgatgtccttttctccataccaggatctgactttggtcattgaaattgccaaaaacaaggggacacaggagtgtgtttggccaggtgggccacctgctgctgctgcctccaaatgttcatcccagccccccacgcactcgggggattttcaaagggtctcacgtgttgggtgccagagacaccctcctgggccttggattcctcctctgtgatgaaggccggggctgctggctcctccacaccacactcggcccccagcagacaggcaacaggggccttgtcccactgtagctgtggtcaggtggtccagggctagacggtcctatggggagctgaggcccccacctcgagatctccctgcccaagacaccagtggggttggggtgggtcaaaggcctgttcctccagggcccatagcaggggcttcttaatctgagggtgagagggtttgggaggtgacaccccaactcccaccccaattctcaccctccacttctcaccccacaagctatcaccatgactgcccacctccacttctcacccccacctctcacccctacctctcacctgccgctctcacctaccacttctcacccccaattcacacccctacctctcacctgccgctctcacctaccacatctcacccccaattcacacccctacctctcactcacacctctcacccacacctctcaccttccagctcactccctctatttctcccctctcaacctcttccttctctgagctcagcctccactgaaaaggtggccttttccccagatagctgggcaggggctggaccggacagattgctggcaggggaggcacacttgctcttctttggtgagagtggctcttgcctcctatgatcctggagctcaggcctgtccagcgcccctcctggaggcagcagggtgggtgtgttcctgcagacatggacagcccaccttggcactcagggcccagcaatccagcccctcctccaggcagccatcctggatcactcctcgctgctttagctgactggcatctcagcacctccccagggaatgtccccaggccctgcaaactcagtcctgtcagcccccagcccgctctgggacccctcaggaatgctcctttcctcgagtcttcttcctcccacggcctccattcccgtggattctccctgctaggaagtagatctcatcccgtttcaccatcagggaaactgaggctgggaaggtaaaggtactgcccagagccatgcctgtgggagggctgggacttgctggtggcctgtgaaggttgggcaggggtggatggctggagtccccaggaccaccaggaccacacctggcagtggaggcctagggtgagggactggggctgagcagggcctctgtgctgccactgttgaatgtgacacagctcctgagaagcaagaccagagacaagttaagcaggcctctgctaatggggcgctaacaaagacaagaagggtgagcaggcatcaggagcgcttggggactcgcggtgggacagccatgagaactcagcccacagccatgtcagtggtggcaaggagaggacggatgtcagctgttttttattttattttattttattttttattattttattttattttgttttattatttttctagagggtcttgctctgttgcccaggctgaagtacagtggcatgatcagggctcactcgaactcctggctaacatgatcctcctgcctcagctcccaagtagcggagactacaggcgtgcaccataacagccagataattttatttttttaatttttgtagagactgggactcactatgttccccaggctagtcccgaacttctagcctcaagggattctccctgctctgccttccaaaatgctgggatcacaggtgtgagtcactacagttagcctgttttattttaaaatatatatatttcctgttttgaatgggtatcctctccttccaccccatccccagcgacctgacacccccagctgtacctgcaggcggtccccctcctcacccccactagacgtatctgtgagtgcctcaccccggccccaccagacctgcaggcctctccctgccctccaacagccagacctgtgggagcccctaagcagcccccctagggaacccccagcctgatgcggctgccatccctgtgggtgaggggcagcatctcactgcagcttagatctgcgtgtttctcactctgagtgaaggtcagcagcgggtgatgggaggttcctttcatgcctttgcccatttttctcttgggctgttgctctttttcttactgatttgtattgagaaccaaaaacggccctttgtgaactgagttgccgatgtttttaccctttgttggttatcattttatggtggtttttttctctccatgcatctgccttttattttcacgaggttgaatatacccatcttttactttatggcttctgggttttgtataattcttagagtgactaaagattggttttttgccatccatgctttcttctaggagttttatggtttcatttttactttttaaatcttagttccacttggaacttgttttagcgtcaaggagtgaggtaggaatccaaatgtttcctccatatgtcaattccgttgtcttaaggccaagtgttgattgtatatgtgggattatttgttgaatattccatctctcctcttggatttgacctgcctcttctcatatttgcatttgagcctctttctggactctttcccatcgtgtgactgtccagggtctgtgttaattatcatggtcttagaatataaggcgtttcaggatgtgacatggcccatctctctccgtatgctccttctttcatgtgaacttcacaattgctctggatgggcctcctgattcattcaaggaacaagccgtcaggcttcagccaggccagagaatgggccgtgggtcccagcactgggctttcatctgggttccatcccattggcctgtgccccagggcctggctcctcgggactcagccagtcctgccggtggagtgcgcaggcgtgacgctgagtgctggactctgtttccacgcgaggccttggggtggaggggtgtctcaagggagtggccaaggcagaggaccctctttctggatgtcctcacttgcccatgggaagggaggtggtcctggctgagccacaaggccctgcaggcccaggccctgcacacatgcaccttggcagagccagccagagaggcctgatgaccagagcacccaagcggcaagggcaggcaggagtgcccaggagggagccaagctgtggccgctctgctgagccatccgttccagcaggcagcaggcagcggactgagaatgctcagttcagaactcgagcctgggcatgaaccggagcctccagaaacctgccccttaagcgggccggctaagagtggcagctgggagctggagacccaggacacaggcagcccccagcagcccatgtggcctcttctcagccacaccccgagggccccgggctctgctcccaccatggccggcctcctgggagcccctcgcctggctggatgggccagtgaggcggtggcattgagcagagggtggtggggccggcagaccccagatgtcctgacacaggctaggagaagcgcctccaaggctggcagcaaaccccagccagcctatatagtcagcaggaatcctggctaaaaataccccagtctcagaggcccaccagctgctgcagtctcagaaccccctcctcacgctgggcactgcccatgtgcccctccacctcccttgcaggcaataaggcctgcggacacaggaggaaactcaggccctgtgccagcaagtcctagccccagggcctggcctccaggactgcccacagaggcccccatcttactgcaaggccagggctggccccgccctgctctgcacccgtgagcctgggcaggggtcagggcaggccccatcaggaccagctcgggcaggggcgcaggctctgctggccccaccctgcacagctccctgtcccatggctctcagaggcagagccactggctggggggcagagccccaaggacttggtctgagtcaccatggcagaatgtggggtgctaggtgggctcttcccagtcacccctgtgggcttcaagtgaccacacggcatggctatgccctttatcctggaatcactggctggggaactcaggccaaggcccacctccccggggctcagtttccccacctgtacccagtggggatatgtggaataggggtccagtaaaggtatacggggtgttacagcttgcctctcagagtgtttgttgagtgactaaatgaatgaggaagtgagcagatgaaggcagtgagggaggctgtgaagggtgggaccactgcgctcagagcaagccctcagcctctccatctgggaaacggaacaaacctgcatgccgcatggatcatggtggcccagagtggggtgcccagggacccagggagctcctacaagagcaaggctgggcactagccagccaaggcatcctagggaccatctcactgtggccccaaggtgggtttggcggtccaccctgccttccactccccacccactcctgctgacagctatcgccatgccttccctgccttccctgctccactgggagctcgtgggtgctttcaacaggtgcccctcccccccaacccaggtttgactgcctgctgggctcctggtgttaacagcagctcccaatttagctgtcactgccaggtgggtggctctagaaggatccgtactccctgcaggggtgggggaggggcgtgaagccacagcggatgccttgggcacagcccagggacccccaccttccggagctctgcccctgcaccagatttgtgcctacagggaccagaagcctcctactccccagccccacccagccggcctccccagagagaggccaccaagttggttgtgcccactgagagaagaccctgagcccatctgctggcgaacacaagtggcccgagctcatctcaaggtccaggaaccctggggactcaccccttcctctgggcaccaggaagagtggtggaccaggggtccaggtgccagcctggcatgtcccacttggtcgagtgtcctttcatctctgttcaggttcccatcctggagatgggccacaagggatccagtccagggctgggggaggcagccctgtgggaggaggcccttgctagtgaagggtcagaggcatttggagatgggcaggcccagtgggattcttggggccactgccaggatttggttgtcggtcccttccttgtgccagccccctttgctgctgcgtgtggctttgatgaataagagatgaggaagcatattaattatggcttaacatgcaccaaagttgggcagagggactcctagggatgggagtcctcaggggtgcagaactgatgggggaagaccaggacaccctctgcagccctggggatgggggatggtgagaggcttctggaggaggcagaggctgtgggcaaagagagggctgagagaggctgccaagacgtgggtccacctaagctccccagacctccttctctggtctggaaaatgggtggtggtagtagtgtctacactgcaggactgaatgggatgactcactcagcaggcctggcacagagtcctctcgggccttgggcatgcagccaccctctgtggtgagagcagatggcaggctgacgccccccagctccctggcaccgggaccacatccctagccgcccactcagagtgcagggaagggttggtcacattgacacgcttgggcagcaggcatgtgcttgccgcatgaccttctagcttccttcctggtctctccttgcattggcctggagtggcccagaatgtgtggagcaaagacccaatttccttgctgcccatccctccccaggagacaccgagggcctggatgtccgtgagaaccgcacaggcatgccaaggaaagccatggcacgcctatctctccaggcgggagatgagcctcccgaagccctgggaagaagggaccttccaaggaggctgaaccgtgtccctgtcagcccaagacgggccactgcgaaaggtcccctcatctcaagctggcttctatgggcaggcatggagttttgagtgaaaaccctgcatgatcctctcaggggacaggaggggtgaacaaaggagggacagtgaccagctgaccaggccctgaggcattagcgtctgcctcgtccacatgctgtgcaagctcagcgaggccaaggggctgggccgaggtcacacagctgggcagggccctcatgaccggcatgctggtcgtggaggccgagccccaggttgggggtgggggtgggaggtgaggcagcccctggcctcactggaggggggtggtgggctggggaagctggcaaaggatgtgccctacatggtgggtgtgaggtggggaacgattcgggcagatgcccgtgtggccctgctgacccagtccaggcagggtgtgacaggtctgcccagccctgaggtcacagctgtctgcagtctccagctcactcctgatccccagggccacgtgtccagaaagcctgggagcttgcatcagctgggcacagatggcctgtcctcccagcacccctgctggggcttcctaggaactgactggtgtagactccgggcagcagacggccaggctctgcccacagggtccctggctcctcccatgaggtgacccgatagaactggctgtgccccttgaccaggggctccagcccttgtcaagccctccctgctagcccctcaccagccgtcagctgccctccctcccttgcccgttgggccctgggggggtgatggctccgcggtcgcctgcccagagagtacaccactccccatgctgccccccgacctggctacaccctgaaaaatgtggcttaccaaaccctcccacatgcacagcctgagaagcgggctgtgccttgctggtagcagaccgaccggctgcctagccctgctcaactctgcctctgcacccccataactccctatcagcgctggcccacacctaatcgttccagctagcacccaggagtgggctcagcttccagtggggagggcgctggccaaggtgctgaccgaggtggcggacacaggaaaccagccggtcccccagcgctccctctgtgggccttgggcctgctcccactgcacagacaggtggggaggtggaggcccaggtcccagcccagagcagctgggaacagccggacttgatggctggagagggctgtggtgccagaagcctccaggttagccctggctccccatttccccccatgcccatcccatgccccagaatggtcactttggctgctgcaggaggggtgggaggggctttaaacctatgagatagggtgtggggtcacaatcttcaattgtagtgggccgctctgggtcactggtaattgaagagacgcctgcatagtaagcacgcaagtgtcctctcaagccctctctgcaagcacagagcagcccgagactggagcctggtccaccccagcgctgtcctcagactgatggtcagtgcctcatgactcatctagggtctgatacatccctgtggtgagagctcagttcctagtctaggggctgctgcgtgcagggaccctggaggaagaatgcttgtttaggggtcaggcctcagcctcccactggctctgtcagcttcgcctgaggttccccatctgtgcaatgggtgatgacatcttggtgtggctctgggaggacctgttgagccacctcaggggctgagctggtggcactcggcagccagcaccctctggggaggtggcagtgtgtgcacagcccaccccttcaggaggccaggggacagagtggctgggggtgtctgggccccacctcaccttctgtgtggctgggaatggcatgcactccacaatgccctcataagcctaggctgggacaagggtgatagggataaagcaggccaaggtgatgagggccacagagcggcagccagaggcatgtgggcagtgcagcctccacaccaggcagagggcccggccagcatggctccaccctgggaagctgcctgccactgggatcagatgggagcaccagggctctgggaggtcctcacttcctctggacaaggcaggcaggtcaccagccctgtgccctgctcatctccctcagggccacctccatggccaggggcaggcagagagcacagggctgcccagtcaccaggtctctctgcttcatatcagtggacctgggctctgaggggagccatcaagacctcaggctggcccactccgtccttgagtcagggtcctacagactgacaccaggttggcctgcaagaccctggtcctgtcatgcagggtgggcctggggaggacccagcccagctgagctgactcccagcactcctccaggtgcagggacagcctggcagttgtctgaagaccccgggatgggcttaggagctcatcatcatcggatgccccccgagcagaagacggagaaggaacacccccaccctgtgtggtgtgtgtaggggtgtcactgggttctctggctccatgacgcccccccggccccgctgggggctggcttagtagagtgggggatgatactaagcaggcggcctcggagagcgtcttctgggtttggaggccacattccgcaggaaggaagaggtgggggacccctgcagggttatgggtaacatcaggcctgggtcccctccctggggtggtgcagagagggccacaaaggcccaagagggcccccagaacgctcttaagccttgagcctgtttcttactgaaaaatgggggcgatcgtgctccagcaaggggcttctgtgcagggggcgggggggggcggggggttcatgggtttcgtgaggccaggaagcgagtgggtcgcgcagaggccatccccaggcctcaatggccccagccgccatcccctccgccgcctgcagggccgccgcctcttcaggaatgcgcggctttgtctagggccgggtgggctgagcacctcctgctgcccggcctacgctccccggccagccgcgccgctcacgccccaacttgggcccgcgccccccagcccccgcccaggcccgcgccccccagcccccgcccaggcaggcgcctgcgcccaggtgagggccccgcccgccgccgcctcccgcgccctgcgcgcccgcggcccgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggaggtgagtgtccacgcggcgccagagcccagcaggcggcggggcgcagagcggggtggttcgcccctcctcggagccgcagggcccgtccagggcttccaaggctggggaagcgtagccgggcggccgggagggccaccgcagtgccgcgccaggctggggccaagggcgccccggccccgggagggcggagccggaggcagcaggaaaagttgccgcttcccgggtaagttgacggcgatggcggggccgggggtggcggcccgggggtccccgaggctgggccaggtccggggtgggggccgcgggctggaaggacggggtccggcctcggcgccgcggccacgaaggggttaatgagcgggtttttttgcagaaacgcgggtaccgagagtaggtggaggtatcgggccgcctccgcccccgcctcgcggactgggctcagaacctcccgtttttctgaggtcaggcctcagggggatcaatgggggcgttggcggcagtagagggcgtgggggacaaggttgtcccaacgctgcctccagggcgggcggtgagaggaggcagcaatgcccagacatccgcagcccgagggacattgagaggcttggctgggggaatcaggggtggtggggcaatcagcatcccctccctggcagccttcgtgagactcccccgccccactgggtgtgaggtcccgcagtggggggcaagggagggtgggctccatgtgagttgggcatgccctgcctggagggtgctccccaggtgcccacccaggctgccctgctgatgtccatggtgtcgcaggctgcacacacgtttccttgcacgtgcacatgtctacacggactgcacacttgcacacctctggtgcacatgcgtgccagcgccaccccagtgtacacatgcacgaacactgggtgcacacacggactctgagggtgcatatctgtgtcctcgcccccgcttgcacgcccacggccacacatgcatgtacgcgacatgcctgctgtggtctccacgggtggcacatgctggggcccctttcacaatacccactcccgcacccacatgctcgtctgttgagtggggaggccaggcccacagacaggggcaagacatcctgggccccacctctgcctgcctgcctccgtgtcctgggggtccccgcctcgggcgtgtgtgcgtgtgtgtaacttggtatgcatctgcacgtgtgtctgtgcgcgtgatcatgtgtgcctgcgagcacataggcatatgtctctttgcctccagggtgtgggtgccccttgtgtgcctagacaggctgtggcctaatctggagcagaggccctggaatgtgtgttgggggctcattgaatgcccccagcccagggtgtgaggggcagggtctcccagccactccgcacccaccagggctgaggcagtgatagatgatggtgggctggaacctgtctggtcagggaagacccatttcaggccatgaggtcaacactgtgaccaacaggccagaccctgggcacccttggtggccgctgcagcttggctgactggagcacgtgacccagcgtgactgcagaggccccgcctccagtacctcagtttctccatggtgaggaccttcttggtgaggggttccgtggtgggctcccctacctccggtgttgtgtagggtgctgagcagatggatgccatgctgcatgatgggcaagggtggcccactagcactgtggcaagggccctgggctggggcttcaattggcaggccacacctcctgctcccctggccaccaccagaggctcatctatagagtggggaccagcaggttatccttgtaggttgtgtgagggtgaaacatactagcagaggggcagctgaagcagtggggctggccagtctctttttctaagcctcagtcttcccatctataaagggggtactgttccctgttcttctctactgaggtgaggaggaagtgagctcccatgccgggggtgggaatgggtggccatcagcacctagaccccacctggcagaggggcacgtgcagggcctgccgtggcagaaccgtgacctggatttgggtcctggctcagccacctgctggcagtgtgaccttgggtgtgacaggtcacctctctgcctcagtcttcctcacctgcaccatgggccagtggtcagggattatcggggcacttccaggctgaggctgggcggaattggcccggctttccctgtggagttccgactctggtgcttctgcctcagaatgcccagaacacctccccacaccccaactcagcagagtcctcctgggacctttgcatggccagctggcccctcaccccatccatttgcagaagggacaataaaagcccctagtcaggcaactcaggccacaggtgagtggagaggggacagggcagggatgctgcccagcttgggagaccctcccatagtaccttcactccctccctgccctccccctgttcctcacctgggggtctgtggaacccctgagcctcagtttccctgtgccagggtccttccactgggactggcagaaacgtaggtttgcatggagtgagaagcaggggagaggttgagggagggcctggcccagcaggtctctgaaagccagagggcttgtggagggtctatggaggacacccccacaggggctggggccctggaaggtgggggaaggtcctgttgtcctgggaggctggggactggcccacagcctgtggaggggctggggtttgtttgctgttgctgtgagtgacaggcaggctgtgagggccagggcatgtgggaccgtgccctccgcctccctctgcccaaggacagtgcagccttgtagcactgccctctcctcgtccctgccccagccttgaattcatgctttgtggcacggacggccctgtgcagccggtgcaacaccaggagggtccagctggtgaggacaggacgggtgggaggcagaggagccctcctgctgtcctgggcctgtggcccggaacctctcaccgggagccttggtctgtgcacctgggaaaggggtcaagaacaggaagcatacggggagtttcaggatgacctggaaatgaacaaatgcatgtgtgagccaggcgccctgcccggccctggcacagggttagtgagggctcccgacgcttggctactgtctgatcaatgaggttcatgccgtcccgcccccattctggcaagcctgacctctgatccccaggctggcctgcctgaccctctgcagccacccagggcctgggctttggggtctgcaggagccggcctggctgcctgctgcctctgcagctgtgcagatgccctctcggggccctctctgcacccctcagtgtccctgctctgcagcctggctgcacccaggccaaggtcacaggcaccctcctcgaagccagatcccagatgctgcatttgccccaactgtccgttcactttctcatttgttcattcatttgcttgttcgttcctagcctgtcagattctcttctgagccaggcaaatcaaggggtgcaatccttggcatcgtgcatctctaggattaaatgctttaaaggataggaggtaacagagtggccccggggaagcccgatcggagtggcgggcatgctaccccaccctgcaaatctccctgcactgtccctggggcccagctgggttccccacaccagttgttctgtgctgccgtttcttcttttatcgctgtattttaaacactttgcacatcgggaactattcttgtgcatcgtgggttttctggtgtgtgtggaatcccttcctgagaatgcaccatcatttatttatccaaacctgcaccggcctcctgcactgcctgcagccgtggagctgggcaccgggagatgcagctctgcacacccaccccaccatgtcctcagctggcacccaccaggtctaggggctggtcacgtgcctctcccctgatgcttgagctgatttcaggggactcggcagcagggccagatcccgcccctcctagccagctgaggcctttgacaaccgtgggctggccgggtgggtgatggtgagtgagtagagtctgggcatccatttgtgcagtgggtgccttggggccgcctctcctctccctctttcacacagcctctggtcttgcccgctatggcctgcggggcctcttctgcggggcagcagggcagcggggcatggggtaatgctgacactgttctgcagctgtgtcctgtccaatggaggcaacccacggcagccagaccaggaggtggagaagaaaggcagggctgttggcacacctcgagagtggccttaggagaggctgagtgggcacaggccagggtccccatgtagttctacacaggcctggcaggcggtaagccccattcagggccctggcacatggagccgggctgatctgggagtgaagtgtcaggtgctgacccagcctcactcagagcagcctgccctgggcccccgggtgcctcttggctctccagtcggcaccctggcattcttagctggctgtcacgggtcacggtccatggagttgaaattctttggaatgttgggggtatcacataagggctttgtggtcaaatgtgggacctgctggaataaatggtgctgatggtgctcctttcccgcagggcatcttgggctctgttttggagaggggtgggcagcaccttctctgagaggcacccctatgcgatgtacctcagggcctggtgtgcccaggaacctgttttgggaaacagtggttgaagtgcctcggaggaccagaggagacctgtgggcctccagcaagtgccccaggatgggtagaccctgccacacaaaccccgcacccacggggcgcccagtgggtggagggaccactgcttcccccagcagtttgaggcgatgtgcaaatttaacctttggatttatgactcaatttctttgtagcaaatgtcacgggaaatgtcaggccaaggctgaggctgggtgaggggcccgtcgaggaagcgggtagggctaggcaggctagagtaccgaggaggggctcaggccagggtgggcttcaggcccctcacctcctcctgggagccttcctggattgtcccttgcttgcctggatccccggcactgtgtcctcaatttgtcccagctatcacaaccttgttgagatgttgcctttatttgccttctaccagggcccagatgaggccagctcggggacatgccagaagtcccccattccccaaggctgggcagccatgggatcagcttgtgcagtgccggcttgctgtatgaccttgggcagctccacccttcctggtcaccgtaggcctctctgcagtccacagctggtggccagaggtggtgttcccagctcagtgccttcaagagtgggaaaacgcctagagtcctcagtatgtggggtgtggggctctggaggaagtgggtgggggctgaatgcagggctggggttgcggagggctggcccttggtggtcccaggggctagagcagcccctgcacacagcaggtgctcagtaaagaccaaaaggcagtgcgtggatgtggaaggtggaggtggattccagctgggagtccacagtccccagttacatgtcccccctccaccgccacatgccagatgtcattccaaggccccacgctggcccgtcaccagctctgccctgcctcccaggcccgggcgggtcagggaatggtgactgcctcctccctgccgtgtgccaggcctgtgcactggagcaggggttcaggctccctagtgctctgcatctctcctgcacacacagctccccacactgcacaccttaggcctccagatccagcctgtctgctagtgtcacatcctccgtacccaatgtccaagcccagagtctcagcctcttccctcgacccatccccaaaagcaaaatcagtgtcaaacctgcaccctgtctcccggtccatcccctttactcctcactgaggaccagcctcagacctggcctctgtccccagcctgtggccacagctggcccctgcaacctccctgcctcctgggttcaagcgattctcctgcctcagcctcctgagtagctgggattacaggtgcccaccaccaagctaatttttttgtatttttagtagagatggggtttcaccatgttggccaggctggtcttgaactcttgaccccaagtgatccacccacctcaacctcccagagtgctgggattacaagcgtgagccaccgtgcctggcctctgaaggacactttcaagagaatacacaaacaacaaatcaggagaaactatttgcaaatcatatatctggtaaaagacttatatcctaaatatacaaataataactctcaaaactcaataataagaaaaaaacctattcacaaattgggcaaaataattgaacagatggttcaccaaagaagacattttgtcagcaaacaggcacctgaatagatgctccacatctttagtcattatggaaatgcaaaatagaacctcagtgagataatatttcacacccactaggatggctgtaatttaaaacagaaaatatcaagtgttaggaaggatgtggaggaactggaactctcatacgctgttggtgggaatataacatgatgcaaccactttggaaaatagtttggtagtttcttaaagagttaaatatgaacctaccatatgacagtcattcccctcctaggtatttacccaagataagtggaagcatttgtccagacaaagatttgtatacaaaggtttatagcagctttattcgtataagcaaaaactggaaatgacccagaagtctgtccacatgtgaatggataaacaggctatgtgatatcaatacagtggaattgacttttgacacatgcaacgtggatgtgtatcatggatgaatatcaaaggattttagacatggataaatatcagaatgattatgctgagtgaaagaagtcagacaaaaaggagtacatactgtatgtttctgtttagattaaattccacaagatgtaaactaatctacagtgacaatatagaagaatggttgcccggggcagggaagggcacggggaaccttttgggggtaaccacctcaactgtggtcagaggttcacaggtacaaacatgtcaaaaggtaccaaattatacgttttaaatgggtgcaatttatgtcaattacacctcaacagagaaaaatacaatgcttattttatgcaaagggttattttgtaaaactcttttgaggaggaccgtcctggtcagcggccctcaccatcgagactctccctgcacatgggtgctgtggtgactcggcccctgggctcaccctctggtgctgtgtgcacctcaagagcaggatggaaaggtcccctccccacagcctggctgtcagacccccggcacagaggtgcaccgtgcagcctcccgtcatttcccatttgcctgcccaagctctcagtgtctgagctctgtcctctttctggaagacagccaggtttagtgttgggagcaggagaccagcatgggctagcccagtcccaccacctgaacagaggggctgtgatcctccaagctacccagggaaggtgccacctgggtgcacagctggtcccaatggtcaggcctccccttgacagaggggcagggccgtgtcatggtcagggcctgtgctctaaagccagactgagggtcaaaacccagctgccccatttacaagcttcacggtctcaggagtgtcactctgcacatcagtttcctcatctgtaaaaccgatcagtgacatctgcctggttacctgctggggcaagtgggtgagttgagtccgatgaagcacttagaacggtgcctggtatgtggcagtgtacagagcatggggcaatcactgcagccgacctagctggtggctccagtgggccttagtgccccaggcatctgaggagcccactcttcagcactgcccccgagtggctgcagcacacactcccccaggactcattcagccctcccaaggagtgggaagcctccggaacctggtgctgtccgaggcacgacacgcaggaagcagggcaggtgtcctccctggcccctcacccttcctagccaggctgcagctgatccgaggtggttccttgatcctggagtctgaagggacattgaggggctacctgtgctccaaacagaccagcccgcttctcatctgcttcacacacaggggttctgggtaagatttcacttcatttctttgaaacaccactctgctgggccagccaagtcctgtagaccccatcacttgtaccccttgacctcagcaacaggaccaagacctgtagaccccaccacttgcaccccttgacctgaaaaacaggaccacaacctacacccagccgtcctcacctggactatgaggatggtactgctcactggctccggacagctgtgtgactccaggggagccagctgtggttgagatctcgggggtcttggtaaatctggtaaactccttgtgcagttctagcgagcccagtgtgaggactgcctgttggctgggaaccgtaaatctgcttgggtttcatgagaatcttgccctgagtgacctccagctggggaactcaccctccatctgcgccagggagagcttggtcattgtctgcagggacccaactaatcaggacgggcttccacgaggagacagatttgaaagtatgctctcttcgggaagcagtagctttaaactggactagctcttatataatgggcactgtgtccctaacgaaaccaaaatatggtccaataatggcttctttgagggaagcacagggcagttgggttgtccaaagccttctttggaacttcacaggtttaaaaggtgatggttcaagaggccccagtattattcagccatataaaggaatacataaacaaaaatgtggcctagccatacagtggaatattactcagccataaaaaaataacattctaatacgtgctacaacatggaagaaccttgaagcatgatcctgagtgaaagaagccagacacaaaaggtcacatgtaatgtgattccactcatatgaaatatccagaataggtcaattcaaagcgacggaagatacattagaggttgccaggggccagggaacagggaaatggggagtgactgctaatgggttctgctttagggtaataaaaatgttctggaattaaacagcagtgatgattgcacaccattgtgaatgtactaaaaccaattaattctaccctttaaagtggtggatcttatgtgaattatatctcaattgtatctaaataaataataatttgtaaaggcctcaggagaggagctgataatcaggacttaatccctgacttggcacactacctgtcacccaactgtctccagtccttcatactcatcaggagccttgtgcaacatcacctttgcacttgaggcttcctctgcttagaatgctgatctgcctgccccagcatgtcccatgagcctgcctggctcagctcagtgactctcggcttctgctctccccattccaggtatcacagcttgtattctgctttcagaaatcaggtagtcaatcttgctggtgcctaggggactggcattctgtcacatataaagagtgggtgaccgccaggtgcggtggctcacacctgtaatcccagcactttgggaggctgaggtgggaggatcacgaggtcaggagatcgagaccgtcctggctaacacggtgaaaccccatctctactaaaaatacaaaaaattagctgggcgtggtggcgggtgcctgtagtcccagctactcaggaggctgaggcaggagaatggcatgaacccaggagagctaagatcgcgccactgcactccagcctgggcaacagagcaaggctccatctcaaaaaaaaaaaaaaaatgagtgggtgaccagcattagagcatcagggaacaccctcacccaggcactcacctgtgggatgaagccacagcacatcaccatgtggaagccaaacttggtcacatactgaggctcagcaccctcacctcttcagcctgttgacagagatccttggcctgaaggagctgtttgtctttctcttaaatgccagacctcagcagagcatcagtacaagcctgggctgcacatgctagaatatgggtggtctaaggatgtactacatacagtagcaattagtcaatatatggatctgccaggacactcctacctgaagcacactggacagcagggttgggtataaaaggggttattattacctcaagcacaccagacaagagggctgggtataaaaggggtcatgtgccaattctactagcttatcagctccatcaaaattcttatttaataatgtcattttcataatgtagtgtaaagggagatggtatacaactcaacctattattgaaatgccaccaagaagtaccatgagcaccaatctagggtagacaatgtggctgggtcaaggtacccaaaagcaatctgaacatacccactgtgttctcctccttcaacttctccctgagcttctggttgtaaaggtgcaaatctgccatctggtctccaagttttgatgcttaacggaggaaagaagaaatgcccctaattaaaataacaaataaaaaataacattatccagtttgttccattttcagaaatgttttaaatacattaaaaactactctgcactctttaaaaagtaaaaaatgaaccccaggcaatgactcttttcctatttcttttttttttcttttcttttttgagacggggtcttgctgtgtcatccaggctgtagtgcagtagcacaatcatggctcactgcagccttgacctccaggcctcaagcaatcctcccacctcagcctcacaactagctgggacaacatgcatgtgccaccattcctttttttttttttttttttttaagatatggagtctccctatgttgcccagctggtcttgaactcctgagctcaggcgatcttcctgccttggctccccaaaatactgggattacaggtgtgaaccactatgcctagccctggcaatgacgctttccaaaatataaaattgtgtaatcacaaagaggaattaagcaggtgagcttcaacagaagtcttagcaggtactaggaattaaaggaggagtgctgaaaaagtaacaataagtgaaaatgcagggtcaggcacagtggcacagtggctcaggcctataatcccagcactttgggaggctgaggtgggaggactgcatgagaccaggagctgaagaccagcctgggcaacatagtgagatcccatctctacaaaaaatttaaaaattaaaaaaaaaatagctataaattttttgtgaaaaccaatgtaaatcacatataggaaaaagactgggactgggtgtggtggctcacaactgtaatcccagcactttgtgaggctgaagggggtggatcactgaggtcaggagtttgaggccagcctggctagcatggtgaaaccctgtctctactaaaaatacaaaaattagctggttgaggtggccggatacctgtaatcccagctactcgggaggctgaggcaggagaattgcttgaacttgggagggggaggttacagtgagccaagatcgtgccattgcactccagcttgggtgacagagcaagactttgtctcaaaaaacaagcaaactgtctgggtggggtggctcacgcctgtaatcccagcactttgggaggttgaggcaggtgcatcatgaggtcaggagatcgagaccatcctggctaacacggtgaaatcccgtctctactaaaaatacaaaagagaaaagaaaaaaaaatagctgggcgtggtggtgggcgcctgtagtcctagctcttagggaggctgaggcaggagaatggcatgaacccaggaggcggagcttgcagtgaaccgagatcgcgccactgcactccagcctgggtgacagtgagactccaactcaaaaaaaaaaaaaaaaagaattgcgtatttgtttgttttgagacagggtctcactctgtcatccgggaaggagtgcagtggcgcgatcttggctcactagagcctctgcctcctgggtccaagcaattctcctgcctcagccccggagtagctgggattacaggtgtgtgccaccacaccctgctgtgtttttgtatttttactagagacggggtttcaccatgttggccaggctgatcaagaactcctggcctcaagtgatccaccttcctcggcctcccaaagtgtaggattgcatgtttaaaaaaaatcaaacctcatgaatgagaccaaagcgtctactggcgcacaggaaaagaacaccctttacttgaaattaccccagggaaaacccaggcacagcctccccagcctggcagcccctgccagcctgtacctagggtgggcgtgagcgtccacagctgggagagcagccggcacaccccagccctgctcccagggtgagccacgcatgcaccaggcagagaactcctgggcttccggctgctaagccccaggggccccagcgtcacctgctctcgtgcgtggactgagcacctactgtgtgcaggcccttctcaggggtgggagggaaggagtggtctcaccctgcagagctttcaggacaactgaggaagtttcccagggtccatgggaagtctgaaccaaaaactgcttcccagtgagtgggactcctcactttgagggatttgggttctgagccagtagagcaggcaatgcaagaggatccgatcccacatccaggctgcatggctctgggagtcctcctgccagcactctccaccaggacccctgctgcccctcagagcaccccccaccagagtatgcagggcctcttgagcccacttgggccaggagggcacccaggcctgcctttccctgcctgcctgctctcaagggttaagctaactttctccatttgtgctaacgttttccatacattctttatttatttaattttttttattttttgagacagaatcttgctctgtcgcccaggctggagtgcagtgttaccgtctcaatctaggctcactgcaacctctgcctcccgggttcgactgattgtcttgcctcagcctcctgagtagctgggattacaggcccgtgccacccccccgcccccactggctaattattgtattttttagtagagacggggtttcaccatgttggccaggctggtctcaaactcctgatccacccacctcagcctcccaaagtgctgggattacaggcatgagccaccacgcttggatttccatacattctggccattgggacgagctgtgcacccaggtgtcacattccctgggtagcttggaggatcacagcccctctgttcaggtggtgggactgggctagcccatgctggtgtcctgctcccaacactaaacctggttgtctcatccacgcagggcccccacaggacctccagtccatgcagggcccccacgagaccttctggtctgcacagggcccccagagaccaggaaggatcccctcgctggaatttgagtcccagcctgcgagttgggccagtggcatttgttctccacgtgtgactctgtaaacagctttccctcctggtttctgtctttttttttttttttttttttccgagacatggtcttgctctgttgcccaggccggagtgcagtggtgtgatcttgactcactgcaacctccacctcccgggttcaagcaattcccctgccgcagcctcccaagtagctgggattacaggcgcccaccaccacgcccagctaattttttgtatttttagtagagatggggttttaccatgttggccaggatggtctcgaactcctgacctcaggtgatccacccgcctcagcctcccaaagtggtgggattacaggcgtgagccaccgtgtctgccctggtttctgtcttgggtgtggtccccaaactcttaagcacagcctcacacctccacccagtcattcacatagaccctggggtgcgcagaggcagagggtcacccgcagaggagctgtccgcatgtccatggcagcctcagtgtggcttctctgctcagcccagggtgtggtgattccgtcactgctttaaatgtggggttcaggaggaattctgatataacagggatgtctccacatgtcttccctgccttagcgtcttgaggtgtacgtggaaaaacctctggcagggctcactctgacagagtcccggcctctgacattgaatcacccacagtctctctagtttatgtggtagggttcgggatttatgaaaatcaagtactaaaaaatgacttccttgtctctttgaattcaactctgattaatgtttgatcctatttattaacttaaaccatgaaattcccttaagtattttaaatggaattaatatacgtcatatatttgatttttattttcctatatcagttgtttggctagcaaacagaccttccaagcatttaaacagtgcttgtaaatctaataaattaagctaaaaatatgaagcacgtttaattctctggattttaatatactttgtgagcttagtaacatttttctattcctcttaaacttaaaaaaaaaaattgaaaactaggccagtttcagtgggtcatgcctgtaatcccagcactttgggaggcctaggcaggtggaacacctgaggacaggagttcaagaccagcctggccaacatggtgaaaccctgtctctattaaaaatacaaaaattagctgggagtggtggcacatgtgtgcctgtaatcccagctactccggaggttgaggcgggagaattgctcccaggaggtggaggttgcagtgagccgagattgtgccactgcattctagcctgggcaacaagagcgaaagtctgtctcaaaaaaaaaaaaaaaaaaaattggagactaatattaaagagcacaatctaaagtgtagggctggaatgaatgaatgagctctctaggcgagcaaagcctttcagggctgatgtccctcggtcccacgagccaggcctccgcaggctgagcactgagcgctgtctgtctgaccagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgagtaaggcactggctgcgttgggggtggaggcctgcaaccctcaggggtgcgcccaggagctgggtccccatgggtggagcaggtgggctcccggcccccacttggccatgctcttagaaaaatgattcagaggctgggcgcagtggctcacgcctataatcccagaacttttggaggccgagacaggcagatcacatgcagtcaggagttggagaccagcctgggcaacatggtgaaaccctgtctctactaaaaatgcaaaaagtagccaggtgtgatggtgcatgcctgtaatcccagctacttgggaggctgaggcaggagaatcacttgaacctgggaggcagaggttgcagtgggccaagattgcactattgcattccagcctgggtgacggggagactctgtcaaaaaaaaaaaaaaaaagccgggtgcggtggctcatgcctgtaatcccagcactttgggaggccgaggaggggcagattacgaggtcaggtgatcgagaccatcctggctaacatggtgaaaccccgtctctactaaaaatacaaaaattagctgggcgtggtggcaggcgcctgtagtcccagctactcgggaggctgaggcaggagaatggcgtgaacatgggaggcggagcttgcagtgagctgagatggtgccactgcactccagcctgggcgatagagggaaattccatctcaaaaaaaaaaaaaaaaaaaaaaaaaaggttcagcagcaaggcctccatttcctcatctgtaaatggagcctttgggaagacagtctgcaatgacacacccatggctcccaggggacaggtcctgggcttgggagatgttaggccgtgatcttgggggtttggcaggccttccagaccctcaggtgtgagactctagaagagtgagtgtcgaggatcctgcctcacttcaggctcactgcagacaggtgtaggtacacatgggatgcaggaagttggaagtcgcttctgttctaaagatggttagtcaactggatatggcggttcacacctgtaatccctgcattgtgggaggctgaggtgggcagattgcttgagcccaggagttcgagaccagcctgggtgccatagtgagaccccatctctatttaaaaaaaaattagccaggtgtggtggcatgctcctgtattcccagctactcaggaggctaaggtgggaggatcgcttgagcccaggaggttgaggctacagtgagctgagattgcaccactgtactccagcctgggtgacagagtgagaccctgtcttaaaaaatacatataaataagtaggctgggcacggtggctcatgcctgtaattccagcactttgggaggccgagggaggcagatcacttgagatcaagagtttgagaacagcctggccaacatggtgaaacccattctctaccaaaaatacaaaaaattagccgggcatggtggtgtgtgcctgtaatctcagctactcgggaggctgaggcaggggaactgcttgaacccaggaggcagaggttgcagtgagcagagattgcaccactgcactccagcctgagcgacactgtgagacaccgtttcaaaaaaattaataataaaaaataaattaattaataaatatgtccagccagtgtcagtgtgacagttgtggtcattttgataacagcaagggttcaagaaagccctgggagtgatgtctgattaaatgaactgtccccccagttcttgctgtcgacatctttgacaagttcaacttcacgggagccagagtcccatggttcgacgccattcatgaagaattccccagggagctggagtcctccatctccttcccagccaacttcttcaaaccacctgaagaaaaaggtagaaccgcttagaaacctgctacttcccttggagtccccagcgttcagggaggggagggctccccctgcgggcatcccaggaggatgaacacgccatactccctgcgcactgaagatccggggccggagtgttccgagtgttcgctggcaccaagtcctattggtgacagcaggttgttttgtccaagtgcttaggtagaggttgagcatcctaatcctgaaatctgaaatgctccagaatctgaaccttcttgagcaccaacctgacacttaaaggaagtgctcattggagggtaagtatgaaatgatactttaaaataaaaaaaaatcaaaatccaggccgagcacagtggctcatgcctgtaatcccagcactttgggagaccgaggcagggggatcacctgaggtcagcagttcgagaccaccctggccaatgtggttaaaccccgtctttactaaaaaatacaaaaaattagccagctgtggtggtgggcacctgtaatcccagctactcaggaggctgaggcatgagaatcacttgagcccaggaggcagaggttgcagtgagccaagatgtgccagcctgggttacagagtgagactctgtctcaaaaaaaaaaagaatccagaatgttcccaaacatttcagttaagggatactcagccttgtaactgataacttgagaaagaaaagagaactgaaatttgtatgtgagctgattgtctttgatgggcagttgaacccgtgaagttgaacttgtcaaagatgttgacagcaagaactggggggacagttcctttaatcagacatcactcccagggctttcttgaacccttgctgttatcaaaatgaccacaactgtcacactgacactggctggacatatttatttatttatttatttatttatttatttattattattaatttttttgaaaaggtgtctcacagtgtcgctcaggctggagtgcagtggtgcgatctccgctcactgcaacctctgcctcctgggttcaaagctgcttctagctgggcatgatggctcacgcctgtaaccctaacactttgggaggccgatatggggaggatcgcttgagcccagaaattcaagaccaatctggacaacataggaaaaccccatctatactaaaaaagtttttttttaaattacctgggcatggtggcacatgcctgtagtccaacctactcaggaggctgaggcgggaggattgctttagtccaggagatgaggctgcagtgagttgtgattatgcctctacagcccagcctgggcaacagagcaagaacctgtctgggtcgggggaggcaggggaagctgattctaaatagaaatagaaattttagactcaccttcccttccctgcaagaaacaaacaaacaaaaacaaacaagaatgctgtctgtgtatgtacaaatcttcactcctgggttgagattatgatacaaaacagtttgaacattctgaactttcttaaggtgctttttttacagatctgtgacaattactaaaaacttccccaaataaaaaggacatgaaaaggtaaactccataatggacagtttaaaattggaaaccttcttagtaaatggattttgtcaggtatatggtgttacctcatgtgtcttttttttgtttgttttttttttttgacagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagtgtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggaggtagattccctaatacccatatcatctttcgttaactctcttaagagtcaccctaaaattactgtgctgacgatcactgtatttcattaagtatccattacaaaacaagcccttatgagtttagcttttatttaacaaatacattgttctcttctaacttgtgccttttatcatccgttgaagctttagaatagtagaatgttcatgctgaaaacgtcttggcattctggtttattatcaggtttacagatctgggactgaaacccgcacaaggataaatggctgcctcaaggctatcttgtgagtccagggcgttatgtaaccagctttcagtactattgctttaagggttgcatcttcctttttttctatttttaaaaaatcagtgcctctgtttatacacaattatgtttttaatttaaatatgcagctaactgtaataatttttaagtgcttatcatgagaaggggtaatcgagttcccatttccttatctctaaaatttcgctgtccagagacaaccatttttaatttttttagctgttgtctttagggattgatggtactagattggtaatacaagaataaccaaccggaatagagaagatgtttatacattcagtaaacttttctttggttttagatttttctgtctatgagctttagttgcgttattgttttcttgctctggaaaaccctaactgaatgcaatcaagatgcctctaaaggttcaattgagagagctttattttgaatgaaaaatctcattgttttttgatgaaatgctagacttagaaatggattggttaaatctgaagaataatgaaaccacttaatctagtataaaatacttttaataaatgaacagaagattttagtgctgcctgaggtcatttaatctcagattgacattgagaatgcagctttattgggggatgtacttcatgaatgtgtgggccacagaagaaaagattggctgtttcttgctggagatgagtggaatcaaaagaattaatgggctggaatggtttagcaggcatatatttatgtgttatgctttgcttgcattctaagctttttttcctaatataaaagttaataatttgtcaactagtaacctctgtgtcaggtagtgtgctgagtgtttaaatagaagttagggaataaaaatagtttctattctcaggaagtttatggactagtcagtaaaaaatacatcagtaattaaaactcagtaaattaaaacttttgtttatggttataacagaatatcagaccaaatctctgatgagactactgtaaaaactgtttaaaatacaaaaacaaatatctttgatggcactggggactaaccaaggcagccaggtcaaatttggcaggagccaaaattgtagagaaaaatcctattgagttgagcccgtatgtacccctgcttttttcccttagggtggtggctaactctacacatggggtggagaccagacaaagcagtggtccagagtttgtttcataaccactgagtagtgggagtaaaacttgaattgagggattctaaggcagccaagatttgagggtccaagatcctaggaaaaagacaacctcaagagtaatgaactcagtcaacatggtggcacatgcctctagtcccagctactcaggaggctgaggcaggaggattgcttgagcctaacagttcaagattacagtgagctttgatcacaccactacactccagcctgggcaacacagtgagaccctatctctttgggaaaatagagagagagaaagagggtagtaaactcaatatttgacttagcttttgctgttaaggtatttttcaaagtcagaaggagaaattcagtagaaagctattacccaagcctaaaaaacgtaagcacagtttttgttctcacaggagtaggttgacaaaaaattagatttcaaggccagccaaagaggaatgacaatgggaaatactccaggccttcggctgagacctcagaagaattatgacctacaaataaaggttgaccagaagttatcagcttgaaatccagcttcaaaactttgattggatcagggtgatcagcccttattctagttacctgccagaagaaacttagcccctatactcttggaacatactatcctgcattccatcaaaataccaggcatggccaggcgcagtggctcatgcctgtaatcctggcactttgggaggccaaggtggtaggattaccggaggccaagagttcaagaccaacctgcccaacatagtgagaccctgtctctataattaattaattaattaaataccaggcatgccaataagcacgatcaagtgaatgaaaatcaagagaaagaatgagtaacagaaagaacttgaggtgatccagatattggaactcttagataggcttttaaaataaccgatttatgagtttaaggaaacagatgaagagatagagagttttaccagagaactggaatctataaaatagaatcaaatgaacattttattttattattttattttattttttattttttgagatggagtttcactcttgtcacccaggctggagtacaatggtgcaatcttggcttgctgcaacctccgcctcccaggttcaagcgattctcctacctcaggctcctgagtagctgggattacaggcacctgccaccaggcccagctaatttttttttttttttgtacttttagtagagacggggtttcgtcatgttggccaggctggtctcgaactcctgacctcaggtgatcctcccaaagtgctgggattataggcgtgagccatggcgcctggccaaatgaaaattttaggactaaaaatacattagcttgagttacaaactcccaagcatgtgtttcacaaccactcaacacggaaaagatttgtgaattagaggactgatcagtaagaaatatctacagtgaagcaccgagaaatgaaaggatgaaaaaaatacagtgtagtggagacacaggacataatagaggggttaagacacatacaattgggttatactaagagaaaagagagggctaggagtgtcataagtgctaaaagtcaaggacagcaaaaaaaatctttaattgctagagaaaaaagatactaggttaagaggaataataagattggcagccgatttctcaatagataacaaaaagaggatttgtcaccagcaggcccattctgaaagaaaaaggaagttctcgtcgcagaaagaaaataataccaaagggaaacaaaatttcaagaaggaataaagaacagtggaagagtaaatatgaaggtaaatatatatgaatattgactgcagtgtaataaaaatgtcttatttaaagatacatgcaggtttaaagtttaagataaaatggttcaaaagttaggagggggcagtaaatataattaaggtgttgcaaggtctttgaattgttcagaaggttaggaaattaatttgtcgtagactctgagtaagtgaagggctgcacattgtaaatctctagtcctacacgctgctacagttgacattcattgcacggagttactgagaactcaaatgtgactattctgaattgagatgtgctgtgattataaataaacaccagattttgaacacttagaagatttcatatagaaaaatagaatgtaaaatgcttcatttaaaaaatactgattacatgttgaaatgatctcttttttttgagacagagtctcgctctgtcacccaggctggagtgcagtggtgcatcacggcaggctccacctcccgggttcacgccattctcctgccccagcctcccaattagctgggactacaggtgcgtgccaccacccccggctaatttttttgtatttttagtagagatggggttccaccgtgttagccaggatggtctcgatctcctgacctcgtgatccacccgccccggcctcccaaagtgctgggattacaggtgtgagccactgcgtctggctgaaatgatcatatttttaatatgtttgattaaataagatacattaatatatatttttaactttttcaatgtggctactataatatttaaaatcacatattgttaacaaagtaataaaagaatggaaaataagaggctaacagaagagaaatggaatattaatacttgattaatccaaaataaggcaggaaaggagagaaaaggaacaaagaactaagggtacagtaatagatgtaaacccaaatatgtaaaaatcacattataggtaaataggctgcatattccagttaaaagacaaagattttcagattaaaaacaatagacccaaccataattttgttcaaaagacccactttaaatagaaagactggaagtaaaagagttggaaaagatgtactatgcgagcactaaccaaaggactgctggaagagctatactaatttcaaagcgtcatttctcagaaagaaatattactagagatagagattgtccgtaatgataaaggattaaaacaattacaatagccaaggcacccttagaaaacaatgtgggaagacttcacgctgcccagtaagactttagaggcacgtagagcacatcataaattcatatgtatctagtaacgcagccccagagaatataaagggaaactgatagaactaaaaggcgaaataggcatatttggaaattttaacacattcctctcattaacgaatagaaaaagcaaatgaaatttagtagagctacagaacatgtaagtaatgctattaactactttgtcctgactgatccataaaacactgcaccagacaacagcaaattgcacattccctttgtgtgtgtgtgtgtgtgtgtgtgtgtgtgtgtgtgtgtgtgtgtgatggagtccctctctgtcacccagactggagggtagtggcgtgatctcgactcaccacaacctctgcctcccggattcaagcgattctcctgcctcagcctcccgagtagctgggattacaggcatgtgccaccatgcttggctaattttgtattttcagtagagacggggtttctccatgctggtcgggctggtctcaaactcccgacctcaggtgatccacccgcctcggcctcccaaagtgctgggattacaggtgtgggccaccgcgcctggcctgcacattccttttaattggccacagtatattcatcagaattggccacatgcactctcaaaaaatttcaatgaattaaaatccttcagagtaagttctcaaagtggagggaaaaatgtgatctaatcaaagtgatgaacaaaagcatttgataaaattcaacacctgtttattagtttccaaaaaaacccccacagaacaaatttctaacaaactgggaataaagggacttttaaaaagatgataaagggtatctacacaaaataatatttatagtggacattaagcctaatggtgacttattgaaagctttcttccagagatgaggaaagagacaagaccctgctctcatcacttctattcagtgttgtatgtaaagctctactgggagactgaggcaggaggatctcttgaggccaagagttcaagactcacctgggcaacatagttagatgcccatctctacaaaaaattaaaaaataaagttctagtcagggcagaaaggcagaaagagagataagaagtataatacttggaaagaaagaaataaaattctatttgcagacatgattatgatgtaggaaatactaacaaagatgcatgtaaaatatgagaattaatagcaagtgaaaaaaatttcaggatctaatttttattagcatttaaaaaataaagtacagtggccaggcacagtggctcacgcctgtaatcccagcactttgggaggccgaggcgggcggatcacaagatcaggagtttgagaccagcctggccaacatagtgaaaccctgtctctactaaaaatacaaaaattagccaggtgtggtggcatgtgcctgtagtcccagctacttgggaggctgaggcagaagaattgcttgaacccaggaggcggacgttgcagtgagctgagactgcaccgttgtactccaaaatgggcgacagagcaagactctgtgtcaaaaataaataaataaataaataaaaattatagccaggctttgctgtgcctgcagcagattagacacagaatgcctcattttaaaagctcataataccaagtgttggcaaggaagcagagaaacaagaacacttgcaccctgctgatagggctctaaactgttctcgccagtttggaaaacattggcactatctgctgaagttgaatagtctccttaagagtcaaaagctggaaacaacccaaataatcatcaagacatgaatggacaaatgaattgtgatatataaggtatacaaaacaagcaaaaaaaaagaacaaactgttgcaacatgcagcagcgtggatgaatctcacacgcataatattgagcagaagcagccagatgcacgggagtctgaactatgattccatttaaatgaagccaaaacagtggtgggaattaatctattataatatgtcagaagagtggttatctttaggggaattgagggaggctttctgggattctgattacattctgtatcttgatttgggggaggtggctacatggtgtattcactttgtgaaaatgcttttagctgtacttatcatttgggtacttcatgtatattatacttcagcaaaaattaataaaaaatatttttggtattttcaggaatgttgttgccccaattatctgtggttctgaggtttttatgtcacatgtttctgatattttactcttcttcatttattccagatgatttattaagatccattagattcattttcttttctatataaaacaaattatttatagtatagtgtattcgttttctgttactattgaaattactacaaatgtagtggctaaaacaacacatagttttcagcttagagttgtgttggttagaagtccagcatggctcttactggactaaaatcaaggtgtcagcagagctgtgttcttttctcaaggctttaggggagaatctgtttccttgccttttccagcttatagaggcagccatgttttttggcttgtggccccttcctccatcttcaaagccaacagctggtcaagttgtcacattgcgtcactctgaccataggttatctgcttttaaggtcttgtgtgatttgattgggtccacctggaccattcaggatcatcttcctgtccttaaaattcttaatcacatctgcaaactctcttgccatgtaagtgaacatgttcagaggttccagagagtaagacatcaatagcttatggggctaccacagataccttatacaattatctcctgaaagttgagtttctaggatttagttgtgttatttttttttataacttgcataccatacaactcaccaagttggacagttcagtggtttttaatgtatgcacagagttgtgtaaccatcatcacaataaattttaggatattctcaccacctcacagccctaggcagccaccatgggtttgcctgtcccagacatttcatgtaacaggaatcatttgtggtcttttgtcactggcatctttcaggtatcattttttttaggttcttccatgaggcatgtgttagtacttcacacctttctatggctgaatgattttttttttttgagacagagtttctctcttgtcacccaggctggagtgcaatggcgcgatctcagctcactgtaacctccgcctcccgggttcaagcgattctcaggcctcagcctcccaagtagctgggattacagacatgcaccaccacacccagttaatttttgtatttttttttttagtagagacagggtttcaccatattggccaggctggtctcgatctcctgtccttgcgatccgcccgcctccacctcccaaagtgctgggattacaggtgtgcaccctgataagtgacaagtgctgattaatttgcatttctctcattatgagttaggttgatcatcattttctgtatttgtgtgtgtgtgtgtgtaaattgattgtgtgattcattcattttgctcattcttctgtctttttttggtctttttcccttcaattttaaaccattttggatgtattagggaccttaagcatttacttgtgagatattgcaaatatactttcccagttttttatgtttttaaattctatttatgatggttttctcgtcatgcaataacattttcactttttttaattaaaaggattttttatttttaagattttaatttttatgtagtcacatcgatcaagtctttgttttacaatttcagatttaaaatcgtagttagaaaaccctggactttatatttgatatggtgtgaaataggtctcagcatttatctttgccccctttgtgtatacacttgacctagcactatttgctggaagactcttgttttctgcattgctgctttggttataaaacatgtgtctataaatatgcagcttcttcagagactgttttactagtttattcttgtgccagtgctgtattgtcttaattattataagtgcaaagtttgtgatttggtgcccttgtgtatatttaactttgtcattacccaaaggcaaattgtaaccagagaagtgtgatgagtaatccacgttgacatgacaatggagggtggttttcaatgtaattattatcaaatgaaagaatatttaacttacggaggaagaaagattagttcaaagacaattttacttttattagcaggatataaaagaagattgaaaatataagaatatgttgagtttatttactggctaatagaggagggacaaattggcaggaaagtggtatgactttcattgtgtgactttttggcatcatagttgatggccagtttttgtgaacagaaacaagtcttaaagaatatgaacaggccaggcgtggtagctcacacctgtaatcccagcagtttgggaggccgaagcaggcggatcgcttgaggccaggagtttgagaccagcctggccaacatggcgataccctatctctactaaaaatacaaaagttagctgggcgtggtggcacacgcctgtagtccagctactcaggaggttgagtcagaagaatcgcttgaacccaggagggggagattgtggtgagccaagatcatgccactgcactccagcctcagtgatagagtgagactttgtctcaaaaaaaaaaaaaaaaagaaagaaagaaaaagaaaaaaggctaagcgcagtggctcatgcctgtaatcccaagcactttgggaggccaaggtgggtgggtcacctgaggtcaggagtttgagaccagactgaccaacatggtgaaaccccatctctactaaaaatacaaaatttagctgggcgtggtggcgcacgcctgtaatcccagctactcaggaggctgaggcaggaaaatagcttgaacctgggaggtggaggttgcagtgagccgagattgtgccactgcacttcagcctgggcgacaagagcgaaactctgtctcaaaaaaaaaaaaaagaatatgaacagtccttgaaattaatgaaattagtgcagtgtctctctctctttttatgtattctagatttcataatgtgacagccctaaatcataaatcaccagagttaaattctgtttaattcattgaaaatattgatccctttttctgcctcttttttttgggggggcaggtggggacagggtctcactctgttgcctaggctggagtacagtggcgtgatcacggctcagtgcagctttgacctccttggctcatgcgatcctctcatttcaaccttcccaatagctgggactacagacatgtgccactttacccagttaaatttttaaattttttgtacagacagattctccttatgttgcccatgatggtgttgaactgggctcaagtgatgcacctcggcctcccaaaatgctaagattacaggcatgagccactgtgcccagccttttctgcctgttcttaacctaatggtactgtattagaactttcataattgaataacagaaatacactccacatggagtcactgacatttagaactggaagagactttagagattagttacttataaactactttgatttgtacaaataaattcagtacaattatctgagagagggcatggttccagataggagatagtgtaaatcggttggctaactcatgccaaagagacaaaacttttgggttcttttgataaaaagtagtttttattttttttccccacagatctttaactcctctgtgttcccttcatttctagaggaagtgaaaacatttcttcactactttttagaataataaatttacagccaatttattatccatagtgttttttaaagctcatattttaaacattgtctttataaaatataaatattgcaaatggtctttatcaagtaatatgatcatttagacagcataacccttgctcaaactgtaaagtctctagttttttattaatatattatgcatgttttagaaaatacctcctttcaatggtgactaaaatttgactactacagaattataaagtaaaaaacataaatttcagaaaaaattctttttttctttttttttttttgtgacagagtctcactctgtcacccaggctggagtgcagtggcgtgatcttggctcactgcaagctccacctcccgggttcatgccattctcctgcctcagcctccctaagagctgggactacaggcacccgccaccacgcccaactaattttttgtatttttagtagagacagggtttcaccatgttagccaggattgtctcgatctccagacctcatgatccacccacctcggcctcccaaactgctgggattacaagtgtgagccaccgcgcccggcccagaataaattcctttagatactggcctcatcatggaatcactttagagcaatgaggattatttgactctcaatgatatttctttctggaaattgcaagatgacacttcctgtggcattataggattttcccaagatatcatgtgctatcccccatcatctgaatctggcatatgtggacacatctcaggcttccataaagtctttgattacatatatgattttattgttttaaaaagaagtacatgatttggccaggcacagtggctcacgcctgtaatcccagcactttgggaggccgaggtggctggatcacaaggtcaggagtttgagaccagcctggccaatatggtgaaaccccgtctccactaaaaaaaaatacaaaaattagctgggtgtggtgatgcatgtctgtagtcccagctacttgggaggctgaggcagaagaatcgcatgaactggggaggcggaggttgcagtgagccgagattgtgccactgcactccagcctgggcaacagagccagactctatatcaaaaaaaaaaaaaaaaaagaagtacgtgattgtttataaacctgtaaagttctatttctgtagcgcagtatggtgtgctgcttactacccgtcagaaagttttggtaatagggctcttgaactcagtataaaagtcatgagctttgttgagtctcaaaatatctaatcttgcttgatctactaaattcgttttcattttctgttgcttctagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttgaaaaaaaaaaaaaaaaacaaccaaaacaccatgttgaccaggctgatgtcgaacttctgacctcaggtgatccgcctgccttggcctcccaaagtgctgggattacaggcatgagccaccgcatcatttaaatgtactgaaagtccaggcatggtggttcagagctataaccctagtactttgagaggatgaggcaggcagatcacctgaggtcaggagttcaagaccagcctggccaacatggcaaaatcttgtctctacaaaaaaaaaaaaaaaaaaaaaattagccctgcgtggcggcgcacggctctagtcccagttacttgggaggttggggcatgagaatcctttgaaccccggaggcagaggctgcatgcagtgagttgagatggcaccactgcactccagcctgggcgacagagcaagaccctgtctctaaataagtaaatgttgccggtaatcctagcactttgggaggctgaggcgggtggatcacctgaagtcaggagttcgagaccagcctgactactatggtgaaaccccgtctctactaaaaatacaaaaattagctgggcattatggcatgtgtctgtagtcccagctactcaggaggctgagacaggagaatcgcttgaacccaggacgtggagggtgcagtgagccgagattgagccactgcacttcagcctgggtgacagagtgagactccatctcaaaaaaaattaaataaaataaaaaataaaaataacagctccctaacagctccggaaagataaacagaaaacagaaaatgacatgctcagcccttgaggccaaaatgcccttccccagagcagctgccagaagacagggagcaggatcgggttggaggtcacttctgggtgagggggagaatggtcagacccgtggcaggggtgttggagcctggtcggcctcactggaacagaagagagctgcttcatgatgctcaactgacaggcagagcctcgcataacccaagttctcatggttcagagaggccagccagtgcggggacaaagacaggcacgcactgaaatggtttcctggaagacggcccggttgcatctctcaaacgggaccagattggaagggagaccagctgctttgggcaaccgaggctgcttctgggtgaactcccaaactagatggtgccgagagccctggacctggcagctgggctggacatcacatggctctgtattccaggaaacggcatctcagtgcttgtctggccagttctccaaaagaaccatccacaggccatttttccattcccttcctatgcacagactgggctgggcctgatcagaaaactctcccttagggttttcagtcactggcgaaacttgagcccggcactgaggataggatgttaaaatgtgactctgggccaggcggcggctcatgcttgtcaacccagtgcttttgggaggctgagctgggagggtcacttgaggtcagcagttcaagaccaacctgaggaaaatagatctctacaaaaaaataaaaataaaaattagccagctctggtgacatgcacctgtagtcccagctacttgaaaggctgaggtggcttgagcccatgagttcaaagctacagctatgatggtgtcactgcactccagcatgaaaaacagagtgagaccatgtcttgaaaaaaggaacaaactaggcatagaagaaacatacctgaaaatggccaggcccagtggctcatgcgtgtaatcccagcactttgggaggctgaggtgagtggatcacctgaggtcaggagttcgagaccggcctggccaacatggtgaaaccccatctctaccaaaagtacaaaaattagccgggcgtggtggcgggcgcctcccagctactccggaggctgaggcaggagaatcacttgaacctgggaggcagagtttgctgtgagctgagattgcaccattgcactacagcctgggtgacaagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtggagcgtggctctgagtcaaaagggtgcccgggtgccgccagttagggctccggtactggaaggagggggtgggccacgtgcgtctagggagtgcagctggcagccggggtccttgccagagactgagtccggctagagaacagggtggagcccctttggaccttagagctgggcctttgggccttgggtctgggtgggcctttgggccttgggtctgggtcagcctttgggccagggctgggtcagcctccagggaacagccgagactcctcttccttggggtgactgcaggttctttttcttgcaaggtctcagtgaggaggcagggtctccacgcactggaatagtgtcaaaccacacacaagagcacagaacccagggacacagggcggctgagacactcagctggtgatggtcctcaggatggtgtcaaccagtatgtaatcacattccacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaactgctagggtgggggaagagcagggggctgctgcggggaccgaggctctcggagaggccaagactgcgtgccccttaagaggctgctgtgggccgggcacggtggctcaagcctgtaatcccagcactttgggagtccgaggcaggcggatcaggaggtcaggagatcgagaccatcctggccaacacggtgaaaccccgtctctactaaaaatacaaaaaattagccgggcctggtggcgggcacctgtagtcccagctattcaggaggctgcggcaggagaatggcatgaacctgggaggcagagcttgcagtgagctgagattccaccactgcactccagcctgggcgacagagtgagcctccgtctcaaaaaaaaaaaaaaaaaaaagaggctgctgggggcggaagttacccgtgagcggtatggggtgaaagtgggagggtccagcctggggcagggtgtagaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagcgacccagcgaagcgacagtagctcgaggtgttgggccgcatcgacgccagcgggaaggtggacatcagattcactgagagccccgggcggcagagggagggggattggaaccagcctccctgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcgaggggttctgagtgagggagtctctgaagagggaactcagctggggtactctaagcaggaggctcccagtggcaggaggcatctggcatctgggaaatggggtggagggttctcgccgccactggccctgccgattcaggcattcccaccgccccatcctcccacagatcctatagaccctagagatccccccacggactccacaggcctggcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacgtgcatctggggggaggcacagatgtgggagatacccagctgccctcaccttgctctctctcacctccgtgggagcactccggccaccccaccttgttcccgagtctacctccatagcctggcgctgcctgtccaggctgtgctccgagtctgctcgcctcgggcccccccaccgccggcagttgaagtgcagctgcagtgcgcggtagacaggcaacagcagcccagcctcccaaatctccaggtggttctgaggatcagtgtccattcagagtagcaatgaaggggaggaggcacacgacaccctctctacctcaccacctgtccatcttgtgccattagggcacagggtatgagcagaggcccttcctcaggccaggtttctccccagtgcggccccattgcctccatggaatggaacccatggtgtccatggctcctgctggtcagcagagcagagctccacagactgcaggggaaacccttcccccccccacacccagcatggcatggaagagggcagagggcagccctcctggtgtggggctctaagcccagctgtgtgtggtcagggatcctggccctgccagagaccctgactcctggtcctcaggggccatggctggttgtgatttgtaaggtgggacctggcacctacacagagggtgcatctggactgctgtgtgaggatgctcctttcctctgaagctagcccctgtggagggtttttggccctgtaggttgtctcagctcccgtgtgtagggggtcctggtccctgtgtacacgcaggagctctcatgccctgtgtggggctcctgcctctgcctaggaggggtcctgaccacagggtgctgacttgtgtggctgtcattctccagggtccaagggcctggaggtgctgagtcatagcctcggaagatgaagggccctagggtagagttccgccggaccctgtgaaagtcaatgttgatgagggactggcctgggcccccacaggcagggggccagcttcttccagtgggtggggactgctggaacaaggactggggcctttggggtggggggggggtcagggaggcagcctgggggtgcagcagagagtggcccccatacacccagaggatagcccagcctcaggaaacctagctccctgcttcccccacacctgaacaggtcacagcaccccccttctcttgtaccctgcatctgacctatccatctagtctcccagttggctgccccatggtgagatgaaggtggaagggtctccggcacacagttgcacacccacactgggacctctatcacctgcacacacttgggctggccacagtaacgggcacaccagccttgactgactcgggaccggcaatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctgacacagcctcacatgacactctgtcctcaccatacttgaggtcctgggagtcatagcaccaggcacctatagagacagtgggcaggaggctgagctgagaggccagtcatctgggccctctccaagccccatcccatcagctggggtccaagaatgaagtaggtcaggggtttaggccaggggaggccagtgaagaaccttctctcctgtcacccctacctcagtattttctctccccagtccctccccactcccagtggcaagacctaaggggtggtggagcatggcaagagggtagattggaggccagacaggaagagtcctggtgctcactctcagagtctgcgccacaccagctgcaccgcaaggcgagcatgatgccaggggcgtgcgtggctcagtggcagccgcagctaggaaggactagaaagtggctagaccacgcagccaggatgctggcctggctactacatatttattcattagctagctgggctaggggcgtggctactgaggagaggatgggaggggtcggtgcccaggcagggccaccaggaagagcgcgagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttggaccccagtgcccatgactttcggggcaaggatgggaggaaggtgtaggatgtctcttgccccactgtgggcccggaactgccaccccatcccaagaccacagcctccctcctacccaggcccccctgcggatccaggccaagacggagccctgcaggaggtcagaggaggggacttctttgcaccctgcgcctctttccaatcgccagagggcagggccctacccacattggggatgggaagacagcccctacccagaggcagggctcggggctctgtccagagtgctgacagtgacctgtgtgctcgggactcaacaccaccactccactcctgccccagcagatgggataaaaaatgaggggccacatcctcgaggctcccatccctgccaagggacttaccagttcctttcctaaccctgactcctctcgtgtccggccgcaggacgtccccccagtatacacatctggagtgcccccagagcagggcatgcaatcacacttcctgggcccactaccctctgagacctagagatggcactgctggacatgagtgaagaggccccagaggacctaggctactttgtaacattaggtggcttggactggagggaggggctgtttccagccacccggatgatgaggggagcttagaggaaatggcgctgacggccaggttccaagccctgccctaccaccccgtcccatgctagctcccagatggtgtcaagcagccttgcctttatgtggatcctgtgcacgtcagcaacacctgccaaggcagcagccgatgccccaagcagggctgggtgctgcaggatagctgtaggcagctcagggctgctgctctccctgcacactccacctaggggctccaggctcagctctgcctggtcctcagggggtttgatggacgcctgcaagggctgcaaaccctaggtgcattctgctgaaaggtgggtacccagcctcttccaccttagcctgtggcagccgtgggggccacaccaaggactaaccatgcctcttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccatggggaaggggccacccagcaaccccggccagcccaaggcccaccctctgcagcctgcatggtccactttaccccgtttcctcactgccccctacgtgtctgaccggcccctaatgttcctctggtccccaaaggaagcgtcccagtcccacacatctcgtgccagccaccctgtcccgcacacacagttctgaggcctggcaggaatcctctgagctctcaggctcaggcccgtgggggactctgctgcgtggtcctcgggccctcactggccacctggcacccataatgcacatgcctgctgctctggaacctggctgccctgccccagtgcatgtgggatccacggcatgcttcctgcttcgtcctctgcagccagtaggggactcctgtggccaggacttccttgttaagtagcagcccttctccaaggggagcacaagcctgcccgcacacagcctccagcatcatgctccagcaggccaagctcagggacaggcaattcagtaacaaaactcacagctctggacagttctggcacaaaggtcaagtctgtctgtgggcaactcaagattctcattccacatgggatggaaaaaatgggtctccagccacagtgtgagaatgtgtcaagaagtggactgtgcatggagtccatccccgagcagcaccacagaactgcatgcttcagacaggcctcccaggtgctgccccgctggtctggaaagactgagcgagacagcactgcctcagcacagcccaggatgcatcgatgaccctggaagagtgggcccccagtgacccgtgaagttccatgtgccaccctcacctgcagacgcttggccacatacacacacagagacacaaacatacaaaggaaagatccagacattcaacgtagaaaagatatggatgtgctaaaaatcgcacagaacccgcttaatctccaaacctcagaaatgttaaaggccctgtgtcaggcaacaaaaccactgcccaggagcaggcaacagggtccgtcaggcaaaagggtgccaggaagggcccccagcccctgcgctgctgaggaggggccgggaggtgtgcatgcggccgctgggcactgagctgcagtagtggcggtgatgtaaggagtggactttaaggagatagatgcagcccaggatggtggtttcagccacccctcctgcaatgaagcaaccctttatggcacaaatggggccgggggcaggcccaggggcaattcaacaggaggcaagagcccagggctccagagtggagagacaggaggcagctcagtccccagaccccagcagagcatctggggcctcggccccactccagagcttcttcctgagggagccatgcacagcaatgctgggagagggactgatggggtggggtcaggcctcctgccacagagctgggctgcagagcccagatggaaagacacagtgaagagctcaacctccttccaagctctccttctcagggcttcaggttccagagccccaggggagctcccagccaggggcagggtcaccttgatattcacaactgggcttgtgggggccatcttcagtgcaaccgttgtgacaaagtcaagaggctgcctccctgaagcagacccactgcctacgccacactgacggtccagaggccccctcctgagggcggccagcaaggggcactgtggcagctcccactgtgcctgtcccagactgggtcagcaggtctctctggacagcacactgcaccaagtaagcccaccaaaaacgcatcaggtgtggccatggcccacagtaccttcttcattccctgcctctaacatgtgcggtctgaatgaattttgtcactcttctgccatttataaaggagaagacagtgatccaaagctatgcatgtttctgaagccctcaaggaagctcggtgcaggccatcacttcttttggcagaaggcgggctgtggtctctatgtacacacgcgagcccgccagtgacgtgcggcagtgcgtggcgtccaggctgggacaggggcctttcaagtctccccagggaccggtgttttctacaacagacaggtgctcccagaccgttggggtacaggccaggccgtctacaccacagtattgagggagctgcggctgtggcggccaccccctggcagtgcctctgcagctggggtgctcccgctctgggcagggtcagggggcacgagcagggcgctgctgctgtcggcagagtcttccaggtctgccagagaggcccccgcagtgggcagaggctgctccaggcgccggagtaatgcaccttcactcccaccatccccaggggctggcaggctgacctccacaggctcaaaagcatcatcgtctgcaggaagagacagaggggtgtcagaggcaggtacgggcctggcacaggggatgcaggggagctaggcaaaaccaggagacactcctcctgcctgaaggcccccctgaagctgggtggtgagcaggacctgggtggctcccccgggcctcagattttgaaggaggagcctgccccacatgacacctgttgtacctactgccccctgtggctgggaacctggtatatgcaaggtgcagggcccatctcacaaaggcagacacgggcctgtcccaccatcggtgtgaggtaggggagacacactgaccagcagtcactagaacagaggggcccaaagggaaaccgtctcagactcagtaaggtgaagacccggctcagcaagaaggcaggggcatttgtcatcagggaggcactgggcccaggtgggtggaagaacattcagggctgcagctggaatgtggcaaccggagtgtgggcaacagggctgcagtgagcggcctggaaaaccacacaggtgtttgcaggaagctctgatccaaggcaggctgtgtggtaggcagtcgactcgctttgttttgcccgatctttattacttgctttttttttcttttaagagacaggatcttaaaagattgcacactggtgtgcagtgacgtgaccatggctcatgacagccttgaattctgggctcaggtgatcctccattctcagcctgcccagtaactgggactacagctgtgcccactatgcacggctagttctgaattttttgtggagaaggaggtctcacaggctggtctcgaaccaacctgggcaacatagtgagacccctcctcccgcctcagcctcccagagtgctggattacaggtgtgagccactgcgcctgggctgcctgcttgtcattaccataggctgtctctgaaagctaacagcacaaggccccggtgatgcacctccctcccggccagcccctcacagcccccaccctgctctgcagcctggcccacacaggtgtctgggatctgctgccacccaccaccatcccttgcaggaagctggtcctaccctggaagactgtgacaatctgtgtcatgagggcaggggtcaaatgcaagtcttttctgcacccccagatcatgcaagagctgtggcagctgactaaacaaacgaacaggactgagacctttaggcacagcagccccagcctcacaatgcccattctgccgagatgggcaggcatgcaaggagccagccactttggggtggcactgcctaccaaatatactacaggtttgtgtgtgttagggggcctaatgcacagggagatgggatgggacacctgcactgctcaacagagacagagacaggccaggggtcaggggcctgccactccttagctacacagccttgaggaatggcgcccactctcagatgggtggtaggctccaactatgggccagtagcacagaagccacgctttcctcccacctcacagagctgcctcctgacacgacaggaggggctgtcaccatggtgtctctagctcatgtgtctacagacaagtgattggctcctgggtctgggccagccctgtcttcacaaccaccactgtcgggctccccaggtctctagagctgggctgagggccctgagggctgcccagatgacaggtgctcacagaaggcagggaggtaggagggaggggtcccaggccttctcagagctctctgcacagattgccaagggcggccaggcagggagatcaggaccccttctgcacgggcagccccaggagaagccttaaaggaaaaaccaaagacaaagccggaaagaagtgaggtccctaggcctctgcagctgggcaagagtgctgggctcagccccacgtgccaggttacttgacaaggtgttccctctccctggggagtcaggcacctgcagggtcatagaacacactgtccgggtggatggaggcctcgtagggcggcggagggtcgtcgggctggccgatgtccgggtacttgtatgccgtgtagggaggtggagggtcgtggaaatggaaagtcccaccctctccgtcgtcagaaagatgcagcggcgtgaggcccgtgccaaacccgtctgggccgtaatcaaagccagggatcctgcggccgaggttgaagtggtgcactgggccatcaaaagtgtgcaacgggaacagagacaagtcactgggggcaggctgcctggctcctgagccccccacccccaggctgggcctgccgtccctgagtgcacacacctgtgccccgctgcctacccctcggccacattcggcatccccatgagacccctggtgtgctccgtggcatgtctcaccctcaccacaccaacctgtccctctgggctgacacttctgtcagacccagcctctggctgaccacacccctccagctggaagggtgatccgggcctctgaccctcagaggcctccgagttctgcccaccctgtggctcaatgggaataaggagggtcttggcaagaactttcctggcccacaggtgaggacacagaccccacaacatgtggccttcaaacctgcctctgcccctctctgtccagggctggggagctcatggagacatggggtgacctggggtggggatggggaccagggttgtggccctcagagggcacttacagtttgctccaatcagggactcgatgcgctcccggcgccgctggcgcagccggtggaccatgaagagcagcagtgacaggatgaggaaggaggagatgcagctgacgaccaggcgcatcccgctggccatggagtcaaacagactgttgccatctgagggggaggggaggaaatggccgctctgagaagggggccaccctcgtgctacgctggggatgctgtcgtcctcctgcccaggcgggctgtgtggacaaggcacacagtgtctccctgcacccaaccatctttaggatacatgtgaaataaggccgctcaaaatcaagaacatggtgacagcacagaagcagaagagcgaatcccaggtcaggaggagcatctcaccatggccccaggctgctgtgtgccaacacccctctgaccatcaccggagcaaactaggatttcctgtcctaggactagcactcctaggaggctgcgctcatgtgctgtgtaccccaggtgtggctggggagcggccctcctgcagaggtgcacatccttttccaggggccagggctgcacacaggcctcccacgtccgtccaacagcagccttccttttgtctgaggcctgggctcttgggaggaaggtgctcagttgcccagcaagaatgagccagggggcggtgagggacagccctttcctggtaggaggccagggttggccaggtaggcaggggtctcatggatgacagttgctggcagtttggagtgggggtgacgcccctgcggagcatggctcgggcggctgccgtagggaggacaggctgcaagggagtagcatagggcatcaggaagccaggaggaggacctgccgcagcagagaagggaatgacagaggcctggaccgggtagtgacagactgggagaagtgacagtataaggtacacttgggactcggattgccacaactccctgatggactgtgtaggggaacagtgagcccctgtgggcagccgcacggtcaactcaggtatcatttcacaaatgtgcctctgctgtggttgggcgtgaagcctgtcactccaatccttaacaagccatggcagagaaaatgcgcatcccctgacgcacccagccctggcatacacgtgcagatgacacctggacacaacactgggtctcacaggctccccactgagatgctctcccggctcagccacacccacacattgggtacacacgcaccaagcgcaggtgtaggagggctgggtggacccgactccacctctttgctgggtgagtaggcaggaggggccatgaagcttgaagctgagtcccagccaggctagacgccaaggagcactgagtctaagctgctgcgccttcctctgctcttcttcaaccatttcacgcttttcgtgaccaccacttggctgggatgctactagtattcagcaggtggaggccggggtgctgttcaacatcctccaggacagcccccaacacacagtatctggtccaaatgtcaacaccgccaagagggacacaccctgccctggtgcagtgcacactggggacaggggctcgatatgagctgcccatggggaggcagagatgacatgagtggtagcaggcatgaaaggagaatctaccagccacacatctataacatggctggcagttccatgcactcctgacttgggtaaactggcaactcacagaagtcacagaataatggaaccaggaagtggtcccagaagtagcttcctccacagaccaagagtgaaggccagggaggcttcaaaacgaggagtgacccatcagctcctggaagcaggaggaccccacaccagcagggaccctgctaagctaggaatggccactcccacctctgcaacaatctcggcaggcaggacccctactgcctgccccaaggagacacttcacaacccccgtgtgagtggctgggttcccagagccctcaagccattcctgctagcccagtacactccatgcccacacagatggcagcgccagctcctgtcctcctcccacggggccaggaagcatctccaaaagctgcattttttgctgacgacacatgaagtgaatatgtgagaaggatacatcctctcaccaattagctgcttttcctgatgcctctgaccctcctccagtctcaagggcactgtcatcagtgggagaaagcctagtggcccagggactggtgacgtgcctgttcattggaggccagttcagagatcccaggggagctcctaagaaagcagcccctttgcaatgactaactcttaatccgttctaaaataaacccaaggacacggtcaaggtcccaactgtccctccaaggtggggaccggaaataatcatctctcagaaccaagccacttgtagtcaagcacaaagaagagagcctgccccagaagccagaggccagcccaggggccccagaggccccttgatagggctgatctctccatggagttctgggctgtgcagttggggttgtcttttgtctctcagctatcctgcagctcccagagagaggatccagcctgtgcaagaagagctccagtgacaaggagctcaccatttcattgagcttggttaagtggtaacagtttcaaaatctccatcagagacaccatggggagcagaaggtcagcagggatcagaagctgagaccaggaacccaatgtgggctctgtgcctggcagctgcaccagccaaacacctcaccatgcctctgggaacctcatcgtatcagggctgcccgacagcagcagagcaagcaggggcagagggcggcatgagtttcagctgctctgcaccttggccagcacttgatgctatcagtttcattactttagcctttcgagcaggggtggtaccccacgtggatttagtttgtttccctaatggccaatactgagcatcgtttcagctgcctgactgtcatcctatatcttctttgataaagtttaataatttacatcttcttctaaagccatttttcaatagcattgttttgttttcttattattgagtttttatgtattctgaatacagacctttgatctgtgttttgcaaatacttgttttgattcagtcaggggcttattttttcatttccttaacagtgtgttccaaagaacagaagttttcaattttgatgaagccaaatttgtctgttttttttaaggatcatgctaaaaatgttgcctaacccatggtcacaaagatttctctcctatgttttctcctagaagctttataattcaaggttttacagttgtgtctatgaccattttgagtaaattttacatacagtaggagggacagtgtaaggttcgtattttttggcatatggatgtcctgctgtcccagcaccagtggttgaaagactatcctttctccactgaactgctcttgcacctttgtcaaagattaggctggtctgaaggtagtgagtcatctcgattgattgttcacagtcagtaacagatcaaactccttgttgtactcttttcccgttctcacgactgcacttgactcgtcttaaacaaacaaaaacagagagatcacctgattatacgtagtgtgggactatttctggactgttgtgttccactgatctatgtgtctgccccttcatcgataccacactgttgtgattactatggctgtacagtaactcatacattaggtggcatggatcctccaactttgttctttgtaaaaactactttggctattttaattattttgcctttccaccaacttttatctacctttttatttaagagacagggtcttgctatgttagccaggttggtcttgaactcctggcctcaagcaatcctcttgcctcagactcccaaagtactacaattacaggcatgagccgctgaacccagccctattttatttttactttttgagatggagtctcgctctgtcacccaggctggagtacagtggcgtgatctcagctcactgtaacctttacctcccaggttgaagtgattctcctgcctcagcctcctgagtagctggtattataggcataagccaccatacccaactaattttttgtattttttgtagagatggggcttcaccatgttggccatactggtcacaaactcctgatctcaagtgatccaccctccccagcctcccaaagtgctgggattacaggtgcgagacaccatgcctcgctccacctgatttttagaattagcttgtcaatacctacaaaaatgtctgctagaattttggttgggattatactgaatctataatttgggaagagctaacctcctaatgatattgagacacctgatccatgaacatggtatctttccttttatttaagcctttttgtcatcatggttttacagtttgcagcaaacagaatgtgcacatattttatattatttataattgggtatttcattttttttggtgctattattaatggcacttttctcaaaattttcaattttcaactgttacagatagattatataaatatgatgaatttttgttacgttgaccttatatctggagaccttgcttaaacacacttattagttctaataactttcctgtagattccctaggattttctatgcaatcatgtgatctgcaaagggagatggtttcatttcttcccctctggcctggatggtttttcatttcttcttgccttctggcactggctttgacctcaagcacaatgatgacagggtggcaagagtagacactcttagcttgttggaggggacattctgatgcttaacacatgacatcctattcccagagtctccagttttggtgatagtgtctcggttcttgagcactttccagaagaaggccctaggagagtcaggagcccatggaagcatggccacagggcaggcagagcagggcccagctaagtcgctctggccgtgcaggagagagggctgcagctgctctgggcccacccagatgcactaagggccctgctctgctaagaagtccttggggctgggcaggctctttaggccatacatgcccacaaatgggtcatccttgtacacatctgggcattcttacaaagcttggacagagtggcaaggcagcactggtagactcctgagaaatggaaccaggagtccaggtagcatggcttgtgaacagagtttgactcttgtagccagtcactaagctgggggtttaaagttatgtggccgggcacagggaacttgataagcactcaaccagtgcttctcatggccctaaacagacatgcaccctatacgaggagaaactgccctgcagaatggggtccaagcatcaccctctagctctgggtcctctggtgggcttggctgcaaatgtagccttgtgctcaccacagtcaactgcacatgtctgatggtacatgccacagtgcccactttcacccagcctcaggcacagcctctggaggacagctttgtcctcccacccagcagccccccagtgtggagggacactgacaacattccactcaggggcagctttcactgttgtggcccagcctctagctgcagcctctcctccacagggcccctagagacagagatggccatcacaccctgcccaagctgctcttctacaggggccacaagtccaggggcttccaaaagtccccatcatttcattcctactgtggcacccaagaaagaaagaaactcatacttttgatttacatttctcttgagatctgaattcacacagagctgcagctacaccggtgtgcagaatgacaaagcatgcccgtggagtgtgaggggtgttaacatctcagagagcagtggcccacctgctcctctctttttgcaagtggaagggagaggatcaccctgagatcagattccctgtagtgtctaccttaaagcccccgcctggtggtgaggagtctgatctcgaaactgagaataatacttcatctttttctcgaagattctaaggtaaaaatggatgactgtaagcaatgacaactgtcactaccctccatatcatcatactagagaacaggaagagctccaatgtggacataaattagaagtctaggctggacgcggtggctcatgcctgtaatcccagcactttgggaagctgaggtgggtggatcactcgaggccaggagttgaagacctggtctggacaacatggcgaaaccccgtctctactaaaaatacaaaaactagccaggcatggtggcatgcgcctgtagttccagctactggtgaggctgaggcaggagaacggcttaaaccctggaggcgtaagtttgaagacaagtttgaagctgtcagtggtgacttgtgaacaaacagccacacttgagttcaagttcatttgtgaatgctgcctgtcaccccagaatgggaaggaggcagctggaggggtcgtgtcagacacgcccactagagtagtggcatcaaagtctctgagacatctctgtgacaaacgctgccattgctgctgcgcgatgctccataaactctcctgagtcctcaccactgaggaagcaaagggacgcccagcctccagccccaaatagggaggctgacttgggacgtcctatcaagagtctcacctgggtccagacacatgaacttgcagcactctttggggtccttgcggtactgttggcagccctggggcctctcacagagagcagccacacacatctcaggctcccctccatggcaggtgcagctcaggcatgggtcgtcccccttaggggtgaagtagaacccttcatccaccacgttgtccttgatgtcaacacatgtttgacctgcaatgagcatacattgtgtacagatgtatacaatgccaaaaaaggtagcctccccgtgtgggccacactgccaaaaaaggtagcctccccgtgtgggcctgtgaatgctacctgttaccttagaatgggaaggaggcagctggagggggcatgtgagacatgcccactagagtaatggcatcaaagcctctaagacagctctgtgagcaaacactgccatcactgctgcaccacttgacatgagctgaccttccccacctgggcctggggaacgaacaaggcaactgaagacttggccagattgtgctgagagtcttcccagggctggaatgccatggatctctggcccatggcacagggagtggctgtccaagagcagtcactacaacactgttagaacaaagtacatctagccagggcaaatggaggccggagagccaggatggagcacaatgccagactccagggtcactgcagaagtgtttgcctggaagttgctgaagtagattacttatgagattttctcaattctaagatgcagctgctatgagtattaaccatttcaaaatcagaatgtgtgtaaggaagctgccagttctgcttgggaaggcagtccactggacctgaggcacactctgcacagagctgacctaggatgagagtaagaggaatggccatggctaaaaacccagagtcttcaactggtaggcagacgttgcaaatgcctggaggagagacaaggaatgaaggagcctccaagagagccaccctcagtgaaaggcaaagagacatgagaaggtagcttcttacagtctccaaatggggtaaggatgtctagaaaaaagactcttccgaaatttcacaatcacaggtctatgcctcacttaagattgtagtcagctgggcgcggtggctcacacctgtaatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgagactctgtctcaaaaaaaaaaaaaaaaaaagattgggatcaaatctaggtcacccatgtggtcaggaactcccagggcaagatactcacatacaattattccctggctaaaatagagaaaaaagaatgaacagaaatgaacagagctcccagagaaatgtgaaacaccattaagtacaccaacatatgtgaaacaggagtaacaaatggagaggagagagagaaagaggcaaaaaaaaattagtcgaagaactaacagctgcaaactactcaaattcattgaaaaacaataacctatacatccaggaagctcaacaaattccacattcctaggataaatgcaaaggagccacaaactgacacatcagagtgaaaatgctgaaagtgaaagacaaggcgaaaatacgaaaagcagcaaatgggacgtgacttgttacttctaagggaaccccaataagacaaacaactgacttctcagcagaaacaacagaggctggggcagtgggataactgctcacagaaaaccatcaaccaagatccatatccagcaaagatatcttctgaaaaatgaaagtaaaataaactttcccagacaaacaacaagtgagagaagttgtttgcagatccaccttataagaaacactaaaggaagtttttcaggccaaaagtatgcaatccccagatagtaatttgaatacaaataagaaactgaagagcaacagtaaaggcaatcgtgattataaattatagcctacatgcatagttttcctcctttattctcttagctgatttaaaaagcaattgtataaaataatatgtatggaatgtagtattgggtctatgacatacaaaaatataacacacttagatttgccaagaatggcacaaaggtggtgtgtgggagcaaagctatactggactaaagaacttcacctaagtctcacatcttattaaaacactcattcgaaacatgtcctagacttaaatgtaaaacggaaaatgattaaaattttaggaaaaaaacacagaagaaatgtaaggctaggcaaagagtacttggacttgacaccaaaagaataatccataaaaggaagctggtttcagtggctcgcacctgtaatcccagcactttgtgaggccgaggtaggtggatcacctgaggtcaggagtttgagaccagcctggccaacactgtgaaaccctgtctctactaaaaatagaaaaattagccaggcgtggtggctcatgttggtaatcccagctacttgggaaggtgaggcacaagaatcacttgaacccaggaggtggaggttgcagtgagccaagattgcaccacttcactccagcctgggcaacagagtgaaattctgtcacaaaaaaaaaaaaaaaaaaaaaaaaatccacgaaaggagagagaaataactaggacttcattaaaattaagaacttttgttctttgggtaaacttatactgccaggaaaaaacagcaacaacaaaacttttgttcctgaaagctcacctgaagaggatgaaggcaagctacagactagaaaaaatatttgcaaaccacatatctgacaaaggactggtatctagaatacataaagaactctcaaaactccacagtttaaaaaagaacaaaacagatcattagttcacacctgtaatctcaatacaggaggatcacttgagcctaggagttgcgtttgaagccagcctaggcaacatagtgagatcctatctctatagaaaataaaaaacttagccaggcatgacggtgcacacctacagttccagctactcaggagactgaagtgggaggactgcctgagcccgggagctggaggttacagtgaactatgattgcaccactgcgtttgagcctgggtgacagagcaagaccctttctcaaaacaaaacgaacaaacgatgcaaagagaaaacggaagaataatgtgaacaacagagaatatacagatggcaaataagcacatgaaacatgaagaggttttaacatcagtagcctcagggaaatgcaaattgaaaccataaggagccacaggtctacatacatatctgcatacctaacagaagggctaagatgaaaaatagtgaaaacagtaagcgctggggaggatatggagaaattaaatcactcctacgttgaatcactcctacgttgatagtgggactataaaatagtacagccactctggaaaacaatttgcttgtttctttaaaaactaaacctgcaactacgatacaatcaagcaactgtaatcctgggcatctatcacacagaagtgaaaacacatttgcagccaggcgtggtggctcatgcctgtaatcccagcactttgggaggccgatgcaggtggatcatctgagactgggagttcaagaccagcctggtcaacatggtgaaacccatctctactaaaaagacaaaaattagctgggcgtagtggcacatgcctgtaatcccagctactcgggaggctgagacatgcgaatcgcttgaacccaagaggcggaagctgcagtgagccaagactgtgccactgcactccagcctgggcaacagagaaagactctgtctcacacacacacacacacacacacacaaaagaaaaaaagaaaaaagaaaacacgtttgcacaaaaacctgtatgcggatgttcacggcagttttcattgtaatagccaaagactggaaacagcccagatgtccttcaacacttgaggcctatagtttgagaccagcttgggcaacatagcgaaatcccgcctctacaaaaaaaaaaaaaatacaaaaataagttgggcacagtggcatgcacctgtggtcccagttactcgggaggctgaggtgggaggttcacctgagcctgggaggttgaggctgcagtgagcagtgatcacaccactgtactctagggtgacagagaccttgtcgccaaaaagaaaaaaaaaaggaacaaatcattaataaaagtaacaatttggatgactctccagggaattatgagtgaaaaaagccaaccccaaaaggttgcaactatatgattccatttatagaacatttctgcctcatgatgatacctgacaaaggccagaccacatatgaccaaaggcctctgacctaccacttctgtagcaaccagtctagggcagtcaggatctggccagtggccaccagcttctctattttgagtccatacttccaactggaaacccaccagggaaagtcaaatatgttccccaaaccaatcacctccactgccctgcttctagtcaggctgcctctaatcagagcatacctggagcctttagggccctggtgaaaagccactgtgctggacccaactccagctgcaggagggtcagaagcacttgtgaaggctccaccctggatcctcagggcactgggcctgcttaaggctcagatacagttagaacatcagaccctactatcagcatgctaacaagccttgagtcacacagtggactactgctaggcgggctgcaaaagacagactctagagatgtagcccaaagggatgacctcaagtagagggtggagcagacattaagaaaaaccctctggcaaaccagcctccacccagaacaacaatgctgctaaatacgaaagcctgaggtgcactgagggcaactacagtgccaacaaaccccaagcccagcccaactctcgcccagatcaacgccctgcactgtactaaagacctccccacaagaaaggcctagtggaagtaaaggcatagccactgcaagcacaaaactactgaactcagtctctattgtcccacacaagatgtcagagttccaatgaaaagcctagaaaaaagtaccatgctccagagacaaaacaatcaaaaaaccagactcaaatatgacacagatgaaggaacttccccacagggaatttaaaataactacgattaatttgttaaaggctccagtggaaaagctggacaatatacaaggttagatgggaaattcagatgagagatggaatctataagaatcaaatggaaatcctataaataaaaaaacagacaaaatcaatgaaacagatgaagaataccttcaatgggctcataagcagacttgacatagccaaggaaagaattagtaaacctgaggacaggtcaacagaaattactcaaactgaaggactaaaagaatccaagagacatgatgactagatgcaatgcatgattctggacaatgaaaaaaatagctataaaggatattattggaacgactgataaaactggaataatggattgtggattactgtatggtactgtatccatgctaagtgttctgattttgatccatatagtgtgggtacataagaaagtgtccttgttcttaggaaatacacactgaagtataaaacgcttaattaaggtccacagtatcttcagtttactcccaaatgattcagaagaaacatgtagagaaagtgaatgataaagcaaatgcagtaaaactgaaatactgtaactggtgagtctgtgtaaatggtgtatgaaaggaagttccttgtattattctgccttttccataagcttgaaattatacctaaattaacaagttacagaagtctccctcgcctgacccagatggtcctataaggtggttctatcaaacactcaaagacaagtttatctccaacttggacaaatggatttagagaacagtaaaataaaatgtttgccaactcattttagaaaactaatatagtataatacagaaatgagtcaatgtagtcccagctacttgggaggctgaggcaggaggctcacttgagcctaggagttcaagactgtactgtgctatgatcgtgcctgtgattagccactgcattcttgcctgggcaacacagtgatgccccaccttaaaaaaaaaaaaaagagagagtcaaggagagtatagaaaaaaatgtaacaggccaacctcacttcttaaaagagtttcaggccaggcacggtggctcacacctataatcccagcactttgggaggctgaggcaggtggatcacttgaggtcaggagttcaagaccagcgttcaagaccagcctgaccaacatggtgaaacgccatctctactaaaaatacaaaaattagccaggcgtggtggcacatgtctgtaatcccagctactcaggaggctgagacaagagaactgcctgaacccgggaggcagaggttacagtgagctgaaatcacgtcactgcactccagcctgggtgacggggcaagactctgtctcaaaaaacaacaaagagtttcaaaaattctaaatatcagcaaaccaaatccaccaatataatatattatatatatataaaccatgaggatggtttaacataagaaaatccatttatatgaaataatgactgaacagactgaagaaaaactacataaccccaataaaatccactaaaagcatttaataaaaatcagtacacttttgtaacacaaatattcccagcaacctaggaataggtacttctttgacttcatacaggtacattctaaaatcctatagaaggcattctgtagaatattgatacattaaaatagcattctaagttgagaagacaagaatgctcactaccaccatttctaatcatcactgtcctggagactgtagcaagaagagttgactgggcaacatagtgaaaccacatctctaataaatgtaaataaataaataaatgtcaaagatttgaaagaagaaacaaacccatctaaatagaaaatcaacaaaatccacaaactaagagaaccaataaaggagtttagaaaacatatcctaaaattcacatagaaaagggtcaaaaataggcaacataacaggcaagaacaaggcagaggaagtcgtaacaccagcagtcaagatttatcatgaagctctctctgttgccagccacctgggaggagctgccgccccggccgcacatctgcaatggatggtcgcgaggaatcatccggcctgatcaaggggaataagcagacccacagcactgagcctgagaacttaaaggctgcagctccttccactacaacgagctgattcactgcaggactgtgggtgtggacccggcagctgatggcaaaggtgtggtggtggtcatggagtggagatccggccagcagaagccagccacctcctatgaggggaccaccgtcgggtggacacggtggctcacacctgtaatcccaccactttgggagggcgaggtgggcggatcacgaggtcaggagatcgacaccatcctaacactgtgaaacccgcctctactaaaaacacaaaaaattagccgggcgtggtggcaggcacctgtagtcccagctactcaggaagctgaggcaggagaatcgcttcaacctgggaggcggagcttgcagtgagccgagatcacgccactgcactccagcctgggcaacagagcgagactctgtcccaaaaaaaaaaagaaaaagaggaccaccgtcaacaagaacgcctgcaccatgctcggcaacatcacacacatgatccgcaagaacaaagcctctccccaacctgcgcacagctgccatcccagagccagcgccatcctgcgaagccagaagcctgtgatggtgaagaggaaggggacctgccccaccaagagctcctgagacccctgtcccccaaaagcaatagagttagctggctttaataaaaaaaaaaaaacacacacaccatagactggcaaggtaaacagagaagcagagaagcagagagaaggatggcagaaatggggggtggggaggtgacaaacagccttagatgctccagagatgccaagtccttgggtcctcattcccatttactctcttaacaacactgcaacagggaggacagggatgattgtctcttccgtgggaaaagaagctgggctctaagatgcttccgtgggctctaagatgctgaccagctgccctggtcacagagctgcaaatgggccccaagaacaaggtgtgagctggtaaggggcgtccaccgcaacactgcaaatcaggttctgcctccgaaaccttgaactcagggtccaacaaagtgacacaagggcccagacattccccaagaacgccagctcaagggggcttacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctgttggggagacaaaaggtggggctggacaacatcacatcagaggacaagctgtgcagtcctcaaggggaccatggcgtcagacaggatcatcaaccacagggcctggaccgccaagtactggtggtcactgtggccaggtgttcactcgggactccccaacctcctgggagtcaccccaggtgctgggcctagcgggagccactccttggagcctgcaagcacacaggccacaaaccctgggtagcagtaagtgccagcctgagcaccagaagagggtgctggatcacggttagtgggtggcatttaaagttagagcaacagcataataacaaagtaatggattgtggcacactggattaaaatgcaaacaggggaatgggcaagggaaacaggcagggaagctctcccttaggacagcacactcagataaacagaagacttacaaagtccacccaacacccaggagaaaggcgccgtcaggcagcattggcactggccggcactgccagcagctggctgcagggaacacttaggaagcactggctcccggggacctctctcagctcaagggaaactgtcacccactcagctcctgcctaagccaggcacaaggcagtcagaaaccgtgtacccctgccgcagagagcgtgagggttggggactgctaacctccaagcctctcttttgcaaggttccaggtgggctctggccatgcccagggcatggcacagccagccctaggccccactctctcccctgcacggcccttccagtctgggctgccaagattccttgaggcttacccgaccaggatcaatggaaacacaaagcaacctttccaagaagcagaataatgaaggcacacctggtgctctccccctcctaagacagcagcagtgcagctcaccccatttataagcctccagcattctcacctgcgtcttttggagctctgtttatacccagcacgaaacatggggctctgcctcaaaaaagccagtgagtctggaggcaggcctatgctgtgggcctgtggacacatggtgccctgccatgggcaggaggacagctctcaggaagctctgagacctgcaagacctgtgccaggccagcaggcagccacagcaacagctgtgcccccttcccagggacatacaggcccagcatctcgcctgcctcatctgcatctatcagacccacagcagagcaggaaaggggcccactgtctggagtcacctccccataccacctggagggctggtctccactgctgacagtgggtgccaccaccatcacgctgtgcaccaccccacctttcctccaggcccccgagcccctgcacaccctcctcatctcccacagatgccttctcacctaagtagagcccctccccttttaaacactgttttcttcactatttgccttcttgtcccgtggcaagaaaaccaaacaggttccttccaatctttaacaaacaaaaaatcttcagcgctgaagctagttgccagctaagagctcctgcccacaactacagtacatgacagcagactgagaccaaggacacaaatgacctctccgggcagagtcctgggacccagcatttgcccacgaaagctgcctggaccggggcacagcaagtcagagtgagtcaggcaaccagcaaaacagggttcgtgtggcactctaggccagggcccagagagccacacagtgctccctcctggcagcaagctgcatgggcacctgtgtagcgcccctgcccaggggagctgctggtggctctgcatccaggtgctgaatgggggctggtcatgcgggcactgcatgcctacccgaggtgcagccttgcagagcgggcaggtgttcgtctttggagcatccctggaagaggtcacagtggcagccatgaacaaggcagcctgtggggctggagaagaggctggggagtggtaggtgatgagggtagtgaaggaaggggctgctggccttgatggaactgtgatttctatgagaaacgagagctgtgaacaagggagcagaggtgaaaaggacccccagcagctgtgtgaggagcggtggggctggggccaggagaccagacagaggccacgagcacaatcgggtgacggatgattgggtgttagatcccggtgggggctgcaagactggtgccaggtgatgagatcctggacatattccaaaggtgtgagaggagcctggaggcttcccgatactgcactggggatgactcctgcagattttcctccagggcctcccacttcctcctggacacccccttacctcaaacatcccgctcttcctgaaggaccctcatcctagagaaaggccctgtgagcagagctgccctggctaccagagtgactgggagcagttcctcgtgcagagccctcctctcaagcctccctccaagacactactcctcaccccctgccaccccagcagatccagtcctcacctcgacagggtggcggcaagtttccaggtgcccctcccatatgtccacacatgaggtgtgcgcaggactctgacgggagccttgggctgggccgtcaccagccaccggaggacaccctgctccccagactgatacacgagggcatctgaacctgattacctctgccaccacatcctctcccacatgtgcgagcagccactgccacctccatgtccaccgctgctcgccgagcctggagaaccctccccggcccccgagtcccccattgttcgagtggtggggagaccttcactcacttttctgagccctcaaagaacctccccttcctgtctcgccacctccacagccacagaatgagcctccactcgggcccaccaggggctgtccagatgctcccgaatgccccaccacggtggcagctgccccactcagggtctgtctcccctccaagaactgtggcctgaccccagctgaccccatcctagaccaatggtcagctcacccagagggcagggtctctacaatgcaccttccagtggctgctaggccagcctggcccctccctcactgctgactgaggcttctaaacgctaggtcccacaggctggcccaggaccacagccctgactgctggcctcagcgggcaacaccatacaatccctcaggtacagcaccagagaaagaagaagacggagaccataaaggactgggcacaagattttgggggagaaaagaaggcttctactaagtcacacacctcctgacctcagccaacctgcaatgtgcgtgctgagacaccacgggggacaaatgagggccaggcactgagtaatcttaaatgagcaagtgacacaacatgtggacacatgaaacacacgctgttttcacttttatattttaaggtaaatatcaagtatgactcaccagacagaagctacactgctggtgctgacgggaaggccctgggagcagcacgtggggcggtgtggatgattctccctacacaaggatctgtactttttcaacctttctgcacaaatgttacagaaatcctggcctcatgtcttctggcagcagcagcggcagttctgtctccagggcacatcatgacctggtgctgtcaaacctgcagggtcttggcccccaggcggggctcacaggctggtgtgggcctgggggagcgcctggagagcgctccaccaaggcgcacaggaaccctgcggaaacgagctcccaacttcaaatgtgtgtgcagggtaccgacacatgggcatagtaagcgtctatgtaccatggtatcactcacaccccaatctggaacatattatacaacacagaaaagatggacaacatgtagatgaaagaaacatttttcaacatcttaatgtgaggcccttccaccatcattagctgatattctcaggtacaatattttcttagggaagggttcagaatgagtaacaaatgacttacatccatttcccatggttttttgggtatttttgggggggccaacacctcagaccccaatgacccctctgctttgcaccatgtccccaggcaggagaaaggctggggtgggctgggctgggctagacgtgctcttgctagcttgttttatactcagtactgtcttcactctgcagcttgcttttggtacaggaatttttaaaacgattccactatggagagaggagtgcgtgcacccgagccacctcggtgctgaccgcaccctgctgcttggctcctctctgccctaccaccctgggagcccctcccctgcagactccaggatactggctcctaaaaccacacaaccacagtcctattgctgcacctaagaaaatgaatcttccacaagtccccactcatttcttgaattgtcctgtggaagattttataagcctcccaacctaggacaccataagggttcttgtgccacatttggttttatgtttctttaatctctttaagcccagaaccactcatgatgctgagctgcatcaagggccagttatcctgcagcagaagaattattgttattgttactatttgttttgtgaccactatttaaatccgctaacagagttcccgaatccatttaactgggcacaagcaggcagtggcacatggtcacctccgtggagctccgggatgctgtggggccccttgcacgttgagccacacaaatagggagctctatgccagctgcagctgccagcaccaacatacgtgttcaatctttttctaaattttaggttcactctcctgcctgaggctccaatggagtcactgagctgcacttggccattaaagcccacccaggacccttgccattctcacaccaagcatgaggcccccagtccccaactctgaatgtgctgtcatcccactcagaatcatgtcttctcttcaaccaccagtgtcaggaggacaagctaccaggataattatgctctatgaggcaaactttgactctggggcctggaaacccagaagccattgattagtcaatagcaatctaaacaatgcactcataaagccagggaatgcaaatgtggctggggctctcaggagggcactggtggtcatgagaacagggtggcatctgtcctgagcaggatcgggacagcaggtgtggccccagtctgctgggctctgcagcccccacctctgctcctgccctgtcccagcagccaggcatggccccgcctctgtggggccctcttttctccagggaagccggccacccaggccttgacccttttcaaccctgtccccaggcccatcactcctcatttatccttcttagagatacttaagacatcaacagcaggactgggatgtgtttacgaaaagaacccaaatcctagctcaagccacaggcacaaagtacagcccaacagacagggaaggggcagggcaagggagtgtgaccctggcggcagctggagaaggcactgctggagtatgtccaggaggagctcgccagtgccagggcaatgggacaggaagggcaagccaagtccgagcccagggaatgtaaaggaaacagcagccatgtttcctttacgtcgtcttggtatttccaagcagctccgcataaaatctttgcgcacacacacacatgcatgctcactctctctctctctctctctctctctctatctgcctgatagtttccttcaggtctggattctacgtctgacctttgtcctggcaagcttgtcctcccctccagcctgccaggggcacactctgcatgctcatttttatactccaaggtctttaacttcaaaaggaggcgggggacaatctagaaagctggccaaagtgagatgcaacagagggttccagagacagccaccgcccaatgcagggcctgatctgcaggctgcactggccccatgaccgcagccctccctgcaactggggctcacccactccctgcacagcacccctacgggccaggcagcactgggtaagagggaggaggggaggccccgaatcagggtgactctgcccagcttcaaacactcccacacaccagaagggctcacctttgaatgccacctcccagcgaccttccaaggagcggttccggccagtgataacatactgatagccaacccacaacctgcagggcacagagacagagacagagatctcagcggcaggagggatgcaaccatcaatgactgtgtgttttttgttttttgagacagagtctcgctctgtcaccaggatggagtgcagtggtgcgatctcggctcactgcaacttgacttcctggttcaagcaattctcctgcctcagcctcccgagtaggtgggattacaggcacaggccaccacgcccagctaatttttgtatttttttttttttttttagtagagacggggtttcaccatattggccaggatggtctcgatctcctgacctcatgacccacccgcctcggcttcccaaagtgctgggattgttttttaatagctatactgacctccacaacactgagcttctaacatgagacactcatgttagaatgcattaaaattcaaaacaagaaagttcacagggcaggaaaagttttatctcagggaactcttgccaagactgtttctatgagctaaaccggtaaagctttcacaatttaagcaagaacaatcttattcttggtagacatgaaaccccatgaatacaactcggtgactatgctaaaaccataggacagggcactccacaggggagattttcatggcatgtgaactgcatctcaataaagacataagtccctgcaaatatccactaccatgggggctgaaaacacttgcacggcttcccactcagagccagcccacctcaggcctgcagcctgctcctgagcatgcaggcctagcactgaaaggaccttgcactggcatctggctgaccgccataagctcctgcctagtccatgtcccttggcccagctttccagccccaagcctagagatgcccatcagcaggtctccccgcatggcaggagcccagggatggcacactctgccctatgctgtgcaaccacaaggctgtcctcagagatggggctgccctgccctccgggctataccctcttgcttctccactggactcacaggcctgtcctcatggggttagtacaacaacctgtgagctaagagttagtttcctccctttgtagctgcagaaggaaaaacaactccgtcttgtgatttgccaaactctcacagggcataactgtggagtcaaaacccagcttgggtcttgaagcgaaggcccccttgctttcttggggggaacccccacctacactgcacaccccttgcacaaggcccacgaagccccacaccaagcagttctccccacacaagccagcacccccagccccctgcctgcgctcagcaactgcacttgtacaaggagaggggtaccaatgaaaggggctgccccacagtcccacaaagtagcagcagagtccagcctgcccctgctcccaggaccctccacctatctcgatgcacactcctacccatggatctcctgggcttccagtgggcgaggctggtcttcccaacctgctgtctgccagctgtgctccaggagtttactgagtggtcagaggccatgtgctcagtagtcatcagactctgactccagcccctcaggtccccaatccaggactcacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaacataaaggacagaaggggagttgtcccccaagttaggatccagctccaaaatggaaattatatgtactccatcagggacaggcacaccttgtaaatcaccctagagaagtggggaaactgaggctcaagaggacaaggtctgcttctgaaaccacattgcagaaatgctcaagtttctctaaaacacagattcaatgatacaagtacattcggtgactcttcccatttctataagatcttttaatttattcactagtcaagaacggctgctgaattaagtcttgtaaagtggatttcattctctgggttaacaacacagcacaactcccatgcagttcactttgggccctgcttccaatgcccagctctcctggcctccgctgccagctagctcactcccctctctcccttttctacttacatgagcatttgcagtaggggctggccaaccctccactaaaacagcagctcaaaggataacagctgggagagccatgacactgtgtgacccgcccctgcctcccacagccgaaaaaaataaggtgtgggcgatgccacaggtggcaaagctaaggagccagccagcacttgagtatcaatgagtctggccagcgtcctctcacttcctccacccatcacttccgactcctacacccacacacgggaatgcctggtaatttacagctcaccttaggtaacaccagtgacctcttttatagaatctttaaccttcaaatgttgggtacctcatattagtacactggagaagagtgacaatttttagcaaagccagttgtaaaattaaaaatgccatttttaaagtgcagctatgtcttgtggcactagtaaaacttctagacacgtatccccatgtatttattatgtaagcatgtgtgtgtgtgacttcttcataaaggcacatagattacagaaaaagaggggcacccctagcccctaagcatggccacagctggacagcaccatctgctcaccgtgaagggtacacctgagtgtgcaaggaagctctttaggtgcagacaaggaatcagagggctggcaacagtggctcacgcctgtaattccagcactttgggaggccgaggtgggcagattgcttgagctcaggagcttgagaccagcctgggcaacatggcgaaaccccctatctaccgaaaatacaaagaattagccaggtgtggtggggcacacctgtagtcccagctacctgggaggctgaggttggaggatcacttgagctcaaaaaggcagagactgcctgcagtgagccaaaagtgcgccactgcactccagcctgggtgacagagtgagaccctgtctgaaaaaaaacaaacaaaaaacaaacaaacaaaaaaaaacaaaacaacaataaaaaatgtcaaggcatcagctctcgagaaggtgtgttgcacattcattgcgtgtttcctgggtgccacaccaatgcatgcagcctgaccacatgccccgcaggtggctctgcaccgtctccatgaagaggtgaggacactgaggcaggcagaggccaggcccctatctcaggcaaggtgagaggaagccctgtagggagggaagctggctgaggcatggagggaaggagacatcccaggatgggagccagctggctggggcatggagggaggaagcactcctgtgcactgactcatcttctttatgttctgaacttggtggagttgcttactacccaggcagaagtgctgcctgttcaaaactgaacagacaggcaaggggaaggaagaacatggagctgagcatcaggaccccctggggctgcactgtgaactgccccttccctacaggtggcctctcagcctcagtgtcttcacacaccaagcctgtgcaccacacttgcactgtggggacccgttcgggctgtgggcacaggccggagacaaagtgcatcaccaggacatgtccagccctgcttcagccgcaccaacatgcgtgaccacctggaaacacctggccccactctggccacccagggttggtgggggttctgccagaagcagacctggtcacctctgaggtgctccccagtgctgaaagtctgggggctgaggagtaacacaagcagacaggcccaaggcagggcagcaggcccatccagtatcagtcctgcctggtccacagccgctgctcagcgtacttgggtacctcgcgcctgagagggtctgctcagggccatttcagtggtggcttttcctcccctcaaccttccttgatgatctcatgcccctttaaaatttcaatgtcataggtaatttattaaataactaatcaccttaaaaatttttcttaaaatggctggacacagtggctcatgcctgtaatcctagcactttgggaggctgaggtgggtggatcacctcaggtcaggagttcgagaccagcctggtcaaggtggtgaaacccggtctctactaaaaatacaaaaattagccgggcgtgatggcacgtgcctgtaatcccagctactcgggaggctaagacaggagaatcacttaacctggaaggcagaggtttcagtaagctgagattatgccactgcactccagcctgggtgacaagcgtgagactccgtctctaaataaataaataaataaataaataaataaataaataaggagtcgagccttcccattttattgctgtatctaaactcagagctggtttcctcatttataaaagggaataatacaactttggaatttccaagggccagtgccttctggccctgaaaagcagtcactttgtgagaacaagcagcctggcctcagagccggttgacttcctagggccttgagtcacataccaccactccagcgctgggtgactgcgggtgggtcatcatgcagcctcattcattcccctcactggcctccaagggctgctttgagaaacccctcacgcagcacagtagtgctggaaaggcaggggtcatgtcaggcttgcactccccagtgtcccagtcagggcaggtctgcaacttactgctgaagcgaacgggctgcgccacgttcaccgcgtggaagtgcgaagggtcgcctcctctggcccgcccctgccgcggatccacagcctccttcccatgatgaggacgcacctccccggtcacttctgaaagcaaaaggagatgtgtgctgtgagtcctgcctgtgcagtcgcagtctccctggccagcatggttcagaccactcagggctgcaaggccggagggggggcctgtagcacagagtccggcaatgcaggctttctttagagccctatgaaacactgccgctcgcatcaaatgggtcccgtgtgcttcttattaaaattatgccgtggcagtttttgttttttaagttactattgtgaaatggaggccctcttcattgcattttctaacaggtcattgctagcacagcaaagggtcctgcataaattaaaatccctcagcagttccagccccatggggatggcccatgaaagagttctctccagagcccaggctgcccctaccccttccttgagggccttctctcccagtatgaaggagacccacgtgtgcaaccttcctctgcagcccttgtcctggggcctgagctgcctatctgtccccctgcctgctggtcccccatggctgtgaaggcctccaggccaggacctcagtatgttcctgtctggctctttggtgcttggcacaggccctggtgtgcagcaggtctcagtgcatggctagaaggtgtcaacaggcagctgaagatgaggaaataactatagttttatacagcatgatctaatagtaatttgcacaccagtgcttccacccacacactctcttttgtcctccaacccccttgtgaaaaaggagaaccacactcctcccatctcacaaggtgaagggcagactcagagaaggggagtgacttacccaaggccatggtgcaggggagagggccctcatgggcccgctcacctcccactctgtacaggtgtaccctgatgtgtcatgaagggcatcgggtacaaggtcaggtcagatgggaaacaaacttggtctgcaaggctgcacacagacagacgcctgccagcaagtgcactctggctgcagatggcgagtggggcctcggctccccaagggaggtcacagggagggttaggaggcctcctgcaaagcctccttccctgaacctgaaccggcagtcagcgccacctgacgagcccctctccagcaggttggttctgctagtgtcatagactttgcaatggtttttatttaataaaaaatccacatgcttttttgctcatgataaagtaacaaacattcaatgtgaaatgcttgaaaaatacaaaagtttgaaaagacaataaacaacaaaggccatatttaactatgcgagcatctgccccctcaccaagtctcttttctacacaaatctttaagaatactgggatcacatcagacactccatttcacgacttgctttgtaagcttaagactataaacagctttctatatttttaaatgggcttaggaacatgacttttgatggctgcatagtattccacaaatggatttctttcatccccataatctctatggtttgaggttaggctgtttgcatttttttcattattctagaaaaggctgccttaaacaccttgtacacaagtgcgtatgtagtctcatttctgagactctggatactcactcagtactcaataagcatagttccatagctcctgtcaggcatgtgatggggatgggttgctattcgactgggaatcactaaaatataaaatatgctacctgtgtccgagacactttcaacagaaagtgaagacctcaaagggagaagcatcttcaaggcttgtgttttttggtagaggtgtctttggggtactttaccaccccaaaatacaacctaaggacctcagtgtgggacagtaactggcaccacgacaggcctgatgctgtaaacacgcagtacttggggaccatcagctctttaggactggtcccatgtcctaagccatgctacctgcagcacccgacactctgggtaggagactcgacccacagactcgctggtagctctgatgcagggatgcagccactaggatggggcatcagcacttggtggagaagggaagagccacctgagcttctgggcctgagactggaagctgagaaagaacagaggggctttctggcagatggagcagctttggcaaagggcaaaggcagacatatccgggataaacctgaggccaggcctgagtgtggctggagaatgtcactgaacttaaattcaacatctccctctgctcaaatgggcaagacctgtggctccactttgtatcctggcctcttccccaagccaagcacagtacctggtaaaattgctcacagaaagacaagatgaactgagggcagaggaaagggaagagaaagaagagataacagagggacagtgctgccaggtcacatgggcaccaaagaccaggttgttacatgttgactgagtgaagtcatctgccccctggggtgggagaccaggtgaaatatttcagaaacataaccagaaagccaaatggtgataaaggacaccactctgttgagcaggcttctctgggtttaggtggcaattgtgagccctttcttttttccatcatgcatctccatatccaaatgctcacattcatcccctcacccccacgtttattcaatgcccattctgggcccaccatggaaacctgccagcacagacacaggcctttgccagcaagaaggggaagggcttggctgtcaagatgatgctgatgtcagacagtgtcctgggggagagtctgggggccaggctggggaatgcgcatagcacaggacagaacccttacagacctctcaggcctgcctctgacagtagagaatgtccctcttcccgcggagggccagcctttggtaagctggggggcctcttccacctccaccagggccatggggcccgagcagccctgcctcacagcccagctggggacctggtgcaggggtcactgtagcacccagagccacatctgctccgactctgggctccatgacctgtgcagctcggagcacatgtgcccctcctgcctccagcaccactagagtgccacgctgctgcttccccagcacaggaacacactggagagcaagttcaacaaggaaacagaatcagggagaatacctagaataccactccacagactatttattcacaaattacttttcgtcacaaaaagggaaagaaatattcacaatagtgatcaaacttaacatcaccaataatgagacaaaatgaccttgggcctcgtgatttgataatttatgacttacatagtattgctacctaaaaaaaaaaagtctcacctgaagctaatcctgaagaaagagacaagtccaaattgaacgccattctacagaactgacctggactcttcaaatatggcaatgtcatgaaagacgcccaaagccccctgcaaaagagggctgggaatacttctagattaaagaacaaagcaatacggcaataacatacttacattaatccttgaataaatcttgaattaaaaggggaaagaaacctgtaaaggatgttctggggataatgaaaagaatctgaatatggattacacagaatagtactacagtaaatttcttgcatgtgaaaaggcttctgtagaggattgttcttattttttgatcatagtatttaggggtagaatatcataatatctgtaacctctcaaagggttcagaagaaaaacacaaagagcaactgcggcaggtgaacccgggtaaaggtgcggcaggacactatcagctggtgaacccgggtaaaggctgcaggagtgtttattgcactatgattatgagttttttatagatctgaaattattcatattaaaaggtgggcgcagggacaaggcaggtggacacacccagattcctcccacaactcaagcagtaaacaaatcaagagttaactggtaagaagataaaacaggtggtgtctgggttaggggacaccagttcagctgaaaatcagggttctttactcagggaagagaggacagattccccatcgccatttttcttccactaagctctcagaaccccaggctccaggcagataggaaatggtcctttatggaaaaaatctgaccaggtcaagaagaaagtccccaacaggaggagattcccaacgaaacatatccagctggttcaccctccagggaagcccacgtgcacagaacttcaagtccctcagccacatacagcagatagggaaggaccaccaaacctctgaggcagagacccaaaccacagaggaaaatagcacagaagaaacaagtacagagacaaaaagttaaaaccaaaaacaggccattaacatcctcaaagtgagaggttctactgtactcatgaaacaagaaaagggtgctattaagaaggagcatggaccgggcacggtgcctcacgcctgtaatcccagcactttgggaggcccgaggtgggcagatcacaaggtaaagagatcaagaccatcctggccaacatggtgaaaccccgtctctaataaaaatgcaaaaaattagctgggcgtggtggcacacacctgtagtcccaactactcgggaggctgaagcaggagaatcacttgaacccgggaggcagaggttgcagtgagtggagatcgcaccactgcattccagcctggcaacagagcaagactctgtctaaaaaataaataaataaaatttttttttaaaaaaaaggaaaatgcagacaacactatccatcattacttgcctctgaaaatgatcttgtacaaatgaacaggaggccaggtgcagtggctcacacctgtaatcccaacactttgggaggctgaggcaggaggattgcttgaggccaggagttggagaccagcctgggcaacacagcaagaccctgtctctatgaaaaataaaaataaaaataattagctgggcatagtggcatatgcctatagtcccagctactcaggaggatgacacaagaggactgtttgagcctagctgtttgaggctacaatgagctatgaccacactagtgcactccagcctgagtgacagtgagacctgtcacacacacaaaaaaaaactgaatacatgacagcaaacatgaaaactcataaaagatttggcagaagttatagaaacctactaaaagtaaaataatcaaagagatggaaaactgcagaggagaaaacgaaaactgggaatcaatccaagagctccaattcccaataataaagagttccagaaaaagggaacagagaagaaaacagaatagaacagagaacaggaaagtgacccctttccctaagctgtaaggcatgagtctaagatgaaaagacccactgaggaggcagtgcaatggttcaaaagatacgcaaaatttccaggaagaaaacaagttatgttcaaagaatcaaaaattatgtcaccagcaacactggtgttggagtaaaaatggagtaagcttaaccttcaaaattatgggaaaaacttatttctagcttatgattctaaaaccagccaaacttatgtgcaaaggtaaaataaggacacttcagacatgcaaacaaggaaacacaaacctttgtctcctatgttccttttccacataagtggggcagtactcgactaaaatgaaggaataaaacaaaacaggaaagatataaaaaccaaacaccagaggttccaacgcaaggagacacaggtgagagtgactgattctcccacactgatggtgaacggggaagctggcccagcagcactgacaggtgaggaccaccaggggcgtctgggaaaggaggggccaaagaactctgactgatagagatctgtaactgaggggacatcaggaaagagacttctaggtacttaaaaagaaaagatatatatgaatctacaggattcacaccaaattggaaaacggcttggcaatttcttaaaaaattaaacatggctcggcacggtggctcacgtctgtaatcccagaactttgggagaccgaggcaggcgatcgcttaaggtcaagagttcgagactagcctggccaacatggtgaaaccctgtctctactaaaaaatacaaaaattagctgggtgtggtggcatgcacctgtaatcccggctactcaggaggctgaggcagaagaatcgattgagcctaggaggttgcagtgagccgagatcgcgccactccactccagcctgggccacagagcaagatgaaaaaaaaaaaaaaaaagtgaaaacacaatgttgtgccaacaaaaaggaaacggagtgctcctgcatggcccagctaggagcagcactgaaagcaggcaagacctcacagagcacagggcccagactcacccaccaggcttagggaagaatcagcagagaatgcctaaaaccacggaatttaaagacacacagataaataccaaatgaaacagctaaaacaatgtttgccttgaaaattagaggggttcatagggtttgctattaaaaaaaagacttacagaatcatttgaatattcaaattgtatgcataagtaacttgaataaagataaaactaaaaatttgaagtagacaatcaaaatcagttcctctacagatctgggatgccccgccccaccttttttttacatcggagctgccgctgaggcatctactgctctgattcctgatccttttattgtgacccaggtttcccgctacaggggttgatgtcctctgcattaccaacgtgctgcagctgcacaaggaggtaattgatacaggcctttttaaaattattgtgccagtcccttccaatccaaggatacaatctttcatttctgggaaattttcttatataacttctttgctaattccctcctcccccatctcctctattttcttttaaggaatttgtattaatcagatattggattttctgaactcatttttaaccacttaagagtgtacagttgggctgggtgcagtggctcacgcctgtaatcccagcactttgggaggctgaggcaggcagatcacaaggtcaggagatcgagaccatcctggctaacacagtgaaaccccatctctactaaaaatacaaaaaattagtcgggcatggtgaaaattagccgggcgtggtggtggacgcctgtagtcccagctacttgggaggctgaggcaggacaatggcgtgaacccgggaggcagagcttgcagtgagccgagatcgtgccactgcactccagcctgggccacagagcaagactctgtctcaaaaaaaaaaaaagagtgtacagttaagtggcattattaagtaccttcacattagttccataacaaccatcaccaccatccatctccagaacttttcatcttaccaaacaaactccgtatccattaaacattacctcccaatttttctctcctcccagcccctggcaaccacaattctacttcctgtatctatgcatttgagtatcttgatagcacatctaaatggaaacatacagtatttgttattttgtgacaggcttatttcactgagcatatcctcaaagtccatccatgctgtagcatgtgtcagaattccttcctttttaaggtaaaccatattccactggatggatagactaccttgttgttgatccattcatctgtgatggacacttgggttgcttccaccttttggctactatgagtaatgctgctatgaacttgggtgtacaaatctctcttcaagtctctgcttccaattctttggagtcgaactgctaagttgtatgataattctacttttattttttgagacagagtcttgctctgtcgcccaagctggagtgcagtggcatgatctcagctcactgcaacctccgtctcccaggctcaagcaactctcctgcctcagtctccccagtagctgaaattaacaggcgtgcgccatgacgcccagctaatttttgtatttttattttatttattttttaaagttcactttattttttgggggggaaggagtcttgtcctgtcacccagactggagtgcagtggcatgatctcagctcactgcaactttcgcctcctgggttcaagtgattctcctgcctcagcctcccaagtagctgggattacaggcatgcatcaccatactcggctaatttttttttatatttttggtagagacggggtttcaccatgttggccaggctgctctagaactcctgacctcaagtgatccgcccgcctcggcctcccaaagtgctgggattacaggcgtgagccaccgcgcccggcaggtaattctacttttaatttgggtggcactgtcatactgttttagtagctgcaccagttcccattcctaacaacaccgcagagggattccactttttctaaatcctcgtcaacacttgtcatttcctgttcaacagcaaacatctaatggctgtgagctatttcactgctgttttgatttgcatttctctaatcattaatgtgcttatcagtcatttgtttatcttctttggagaaatgtctactcaagtcctttgcacattttttttttttttttttttttttgagatggagtctcgctctctctcccagtctggagtgcagtggtgtgatctcggctcactgcaagctccacctccaggattcatgccattctcctgcctcagcctcccgagtagctggaactaaggcgcccgccaccacacctggctaattttttgtgttttttagtagagacggggtttcaccgtgttagccaggatggtctcgatctcctgaccttgtgatccgccggcctcccaaagtgctgtgattacaggcgtgagccgccgcacccagtcctttgcacattttttaaccaggatatttattattattgagctgtgggaattctttttatattttaaatattaacccttaccagatatgagtttcaaatgttttccattctgtaggctgccttttcactctgttgagtgcttcttttaattaatagaagttttaaattttgacgtagcttaatttatctattgtttcttttgttgcctgtgatttaagtgtcttatgtaagaaatcattgccaaatccagtgtcacgaagactttattatgtttttctaagaattttatagtttaaggtcttaaatttaagcctgatccattttgggttaagttttgtatatcattagctaagggtctaactttattcttttgatttgtatgtccagttttcctagcaccattcattctgaaaagacactttttccctcactgaatggtaatggcatccttgtggaaaataatttgaccactgtatgcaaggacttattgctaaggctctgtattctattccattggtctatatgtctgtctttataccaatactacaatgtttggattactgcagctttgtaataaggtttaaagtcaggaattatgaggatttcatatttcttcttctttttcaagactgttctggctctttggagtctgctgagattctatgaacattaggataaatttttctacttcagcaaaaaaaacttgttggcattttaatagggattgaatctgtagattgctttaggtaatagtcacatcttacgttttacagtccatgagcatggaacatctctcaatttatttttgtcttttttttttttttgagacagtgtctcactctgtcacccaggctggagtgcagtggtgcgatctcagcttactgcaatcttcacgttctgggttcaagcaattctcctgcctcagcctcctgagtagctgggactacaggtgcacctcaccacacccagctaagttttgtatttttcaccaagacaaggttttgccatgttggccaggctggtcctgaactcctgacctcaagtgatccacccgccttggcctcccaaaatgctgggattacaggtgtgagctaccacacccagtgtcttctttaatttcttttaacattttgtagttgtcagtgttttcagtctttcatgtgtacttaagaatattctttagtacagacagacccccaacttatgatagtttgactaaaaaatttttcgactttacaataggtttaagacataaatctgttataagttgaggaatatctgtattttattctttgtactattactgtaaatggaattattttcttaatttcctcttcagatagctgagttagtgtacataaatataaatacaactgattttgtgttttgactttgtgccctgcaattttgctgaattcatttattagttctaaccatgtttctgtgaaatctttaaggtttttatatataaaatcatgtcgtcacacatacaaacagggataactttacttctccctttccaattttgatggctttctcttcttgattaattactgtgggcaattaacttcaatactatggtgaataagtggtgaaagcagacatccttgtcttgtctctgatcttagaggaaaagctttcagtctttgaccactgactgattttagtttgctgagacatccttgcattacatttggtccaagccttttgacagactgctaaacttggttaacttggttttgctagtattttgttgaggattttgtatcaatattcacaaaggatattggtctgtaattttctagtagtattactgtctggctttggtatcagggcatgttagagtcacagaatgaattcacttgagaaggactgatgttaattcttctttaaacgtttggagaattcatcagtgaagccatgtggttcaggacttttctttgttgagaggtttttgattactgattcaatctccttattaattatagtcctattcagattttctatttcctcatgattcagtcttggcaggttgtatgtttctaggaatgtgtccgcttcatttaggttaagcaatttgttaatgtacaattcttaacagtattctcttataatcctggcatcaagtaatcctcccaccttgaactcccaaagcactgagatgacagatatgagcccagcccaaaatccaaaactcttgagtgccaacgttgtactcaaaggaaatgctcactggagtgttcaactggtaagtataatgtaaatattccaaaatcagaaaaaaatccaaaatccaaaacacttctggtcccaaacatttcagttaagggatactcaatctgtattttgaatgtggctttttcttgattaggcattttcttagctgggctaagaaacctctgactgttttccagagcttctataaagttattccatctagtccctagttgcttattaatgttttctatggtggaacgagaacctggagcttcctggactgccattttaccaatgtcagaatacatttttttaagttttattacatgaataaagtaactgctaattgagggattactgtgtgctacattcttgtctaatccctttatatgtagcatgtaatgtaatcctcacaacaaccccaagtgacaggcactattattttctccattttatggatgcaatttgcccaaaggatcacagccagtaagtggtgaaagcaggggagcagccccagtccctggctcaagcccccacatttaaccacgatatgacatacagcagagctggctgcctcaggccactttgctgtggcccttctggtctggtgtgctttgttcagactctggcgaatatccacagtggatgttttcttctagatctggtcagcactggttgtctttcatcataagaggaaggtgacccagctagccagaggctctagtgagcctagtgggctagacgcttgtcagggaccacggtgggagagctagtctttcagttggaaaccttccattatgttgacacttttctacctcttgtatgaagtgccagtgtctctagaaaagactcctccaatctcctgtctgggaaaacacctggctgctgacatctggagagcagggcagaagacaggcctgagcatcctacttattacctacttgtcactacagagaatttctcttaattcctctattttcaacctccacgactcccctctgttgtacctggtgtcacttattttgcagactttaagtgctgtctaatagaaacacaatgcaaaccacatttcaacaagtagaaacaaacatgaaattaattttaatactttatctaacccaatatattcaaaatactattactgcaacatggaaacaatataaagaagtattcatgggatgttttacattctttttttgtactaggtctttcctatttggtgtgtattttacacctgctgcacatcttccttcaaaacagccacatgtgactcatggctactacactggacagtgttggtctagaaaatcaactcctgcggggcacagtggctcatgcctgtaatcccagcactttgggaggctgggggcaggattgctagagccccggagttcaagaccagcctcagcaacagggcgagacctcgtctctacaaaaaatttaaaaattagctgggcatggtggtacacgcctgtagtctcagctactcaggaggctgaggtgggaggatcgcttgagtccaggggtttgaggttgcattcagctgtggtttcaccactgtactccaatgggcaacagagcaagactctgtctcaaaaaaaagaaatgaaaccccacatcttatggtagcagaaagagtcacccagtgatggaaagtgaagaagggaatgcgagtgccaagagaattccaccaatccctatcccactcccatgcctatgcctgatgcctgccacccttggcactcagagccttcaagcgctgagcctttctgggaggctgctgggcaaactgcttatttcttgttgttctcactcaagcaggcccatggttgcagctgctctgctacaccaggtcagtttaactctcccattggcttttctttggaaaggaaaaaagctgtataatatgtgaaacatttcaaagaatgtatgtagcacacatgtaagattcataagcctaataatatagttgtgagcgacctccccacaccccatttaggaaatcaagcattattttgcttctcccagtcttatatccctctgtctctccaccaggaactagaattttgtgtatcactgcgcttatttttttcttttagtttaccacatgtgtatgtatctataagtaatataacgatctgttttgcttctctatattgtgccatatgtcgtttttagcaacttgcttttagctgacgttctgttttcaagattcatccatgttgctgcataaacctaacattcacttactgttgctggtgtataacattccatcatgtgagcacagacatttgggttgtttccaagacatgtatcaatggcaaaaattaagatgtctgacaaaaccaagagttggagaggatgtggatggcttggaattttatctgctcctttacacccactctggaaaaactgtacaaacaattctgcaaggatttttccagagtttccctaaatagaaatcctggatcacaggaaataagaatgttcagctttgcaagataatgtctctattccagagtgggtgtaaagaagcacataaaatttccacactatccatatcttctccaacattttaatttttgccagtctaagcatctgtaaagtggtatctcactgtatgtagtcttagaatactaacgaggttaaatttaaatgtctttttctatgtttaatcaccatctacgaaatgctttataggagttctttatatacactgaattagaatccttatcctttacaggctgtaagtgttgcaaatatcttctctctactctagcttgtcttttcacagtctttactggtgttttttggggttttttttgtttttttttttttgaaacagggtctcactctgatgtccagtggtgtaatctcggctcactgcagccttgacctcagggacccaggtgaatcttcccaccttagcctactgagaagctgggactacaagtgtgtaccaccacatctggctaattatttctttttttttttttttttttttttcatagagacaggatttcaccacgttgccctggctggtctggaactcttgggctctggcaatctgcccaccttggtctcccaaagtgctgggattcctggcataagcacctggcctattggtgtctttcaataaacgagagatcttaattttaatctagcaaattcagtcatttttattttagagtgaatattttatgtgattaagaaaaaggtggccagaggctaggtatggtggctcatgcacctgtaatcccagcactttgggaagccgaggcaggcagatcgcctgagatcaggggttcgagcccagcccggccaacatggcaaaaccccgtctctactaaaaatacaaaaattagacgagcgtggtggcagatgcctgtaatcccagctactcgggaggctgaggcaggagaatcacttgaacccaggaggtggaggttgcagtgagctgagatcgcaccactgcactccagcctccagcctgggtgacagagcgaaactccatctccaaaaaaaaacagaaaaaaaaagaaagaaagaaagaaaagaaaaaggtggctgggcgcagtggctcatgcccccgtaatccaggcactctgggaagccgaagcaggcagactgcttaaactcgtgagttagagaccagcctgggcaacgtggcgaaacaccgattctacgaaaacatgcaattagccgggcatggtggtgcacgcttgtagtcctagctactccggagactgaggtaggaggatggcttgagcccaggaggcggaggttgcagtgatacaagaacgtgtcactgcactccagcctgggtgacagagccagaccttgtctcaaaaaaaaaaaaaaagaaaaagaaaaaggcacacttccctatcaaggtcttaaagatagtctcctataatttatccaaaactgaatttcctgtatgttgtgagttagggatccaactgcatccttctccgactgtcacagcactgtgtttgaagagtctgccctttgcacagcgatatgtaattccacctctggaattcaagcttcttaggtctgtttctgacagcttctgtctcactggccaatttggatttccctgagccaattttgaagtaaatcttgatacgggcaaggcaagtgctccctcctcattcctcttcttcacaacgacctctcaatactacgacttaattcttctcaacattttagaatcgacttatcgcatttcacataaaactcacggagctttaaagatgcactgaatccacagaacaatatgagtttttaaaagattcggtcttcctaggcaagaacattctgccactatttacttgtcttctttaatgtctcttaataaaactgcaaatttttctccctcaaaaattttacacatcttttgttaattctcgtttatatcaaagatggttcccctctccctctccctctcccccctccccctccccctctccctctccccacggtctccctctccctctctttccacggtctccctctgatgccgagctgaagctggactgtactgctgccatctcggctcactgcaacctccctgcctgattctcctgcctcagcctgccgagtgcctgcgattgcaggcgcgcgccgccatgcctgactggttttcatattttttttggtggagacggggttttgctgtgttggccgggctagtctccagctcctaaccttgagtgatccgccagcctcggcctcccgaggtgccgggattgcagacggagtctcgttcactcagtgctcaatgttgcccaggccgaagtgcagtggcgtgatctcggctcgctacaacctccacctcccagccgcctgccttggcctcccaaagtgccgagattgcagcctctgcccggccaccaccccgtctgggaagtgaggagtgtctctgcctggccgcccgtcatctgggatgtgaggagcccctctgaccggccgcccagtctgggaagtgaggagcgcctcttccctgtcgccatcccatctaggaagtgaggagtgtctctgcccggccgcccatcatctgagatatggggagcgcctctgccccgccgccccgtctgggatgtgaagagcacctctgcccggccacgaccccgtctgggaggtgaggagcgtctccgccgggccaccccgtctgagaagtgaggagcccctccgcccggcagccgccccgtctgagaagtgaggggcccctttgcccgggagccgccccgtctgagaagtgaggagcccctccgcccggcagccgccccgtctgagaagtgaggagcccctccgcccggcagccaccccgtctgagaagtgaggagcccctccgcccggcagccgccccgtctgggaagtgaggagcgtctccgcccggcagccaccccatccgggagggaggtgggggtcagcccccgcccggccagctgccccgtccgggagggaggtggggggtcagcccccgcccggccagccgccccgtccgggagggaggtggggggtcagcccccgcccggccagccgccccgtccgggaaggaggtgggggggcgcctccgcccggccagccgccccgtccgggaggtggggggcgcctctgcccagccgccccttctgggaagtgaggagcccctctgcccggccaccaccccatctgggaggtgtacccaacagctcattgagaacgggccatgatgacaatggtggttttgtggaatagaaaagggggaaacgtggggaaaagattgagaaatcggatggttgctgtgtctgtgcagaaagaagtagacatgggagacttttcattttgttctgtactaagaaaaattctcctgccttggaaaaaaaaaaaaaaacaaagatggttccactgggaaaacagaaaccatgctaagggatttctaacacgaagggtttaatacagaaaataggtgctttcaaaacaactggcaaggctatatagtgtgagcaaaagtaaagtgggctaactccccatctaattcccacagtcattgtcaagagtcaggaagctactactgccatctataggttaggaaactgcaaaaatctgctgccaatactgcagctgctctgcagccctgagacagctggccagtgggggaaggcagaagccactgcaaaaagtcacctcaaaaatctaagcccatgcacacccccaacatacactatggcctgaggaagaaaggttccacctcccttccacttgccacatttcccaagacacatgtcatagggcaaatgacacacagaagcctgctgccaggtggttctgagtgctactgctccagcattccagcctctgaaacccacggacaagcccagaagggagtgagtgggaaggtactgaatgcccaggctgtacctagcatgtcatttccctcttttcaaaaacatgcagaaattactgatctactgttacatctttcccctttttttgtccctttggttttacattttttatactcctttttagcaggcttttagcagggcaatgaagtaaccccataaggtaactccagaagtcctgaagtctagttcaaaagcaacttgactgagaatggcccagggcttccctaggggttactgaaactctcctcatacaaaggaaggtcacagcttttgagcaagggtggttattagctaactctctacttcccccacaaacacaaagagtttccttttttgagaggggaggaggttgggggaagggagagtgtcaatgaggacttgactctatatctatgattttttaaaaatttcttttaaaataaactagaaaaaaaatcacaagatttagcagtcattaattcaaggaagtaagaaaatacgtattacacattctttgtacatttttatgacttaatttgctcagaatctcaactttaagaacaattagaaatcaacctgcttggccgggcacagtgactcacgcctgtaatcccagcactttgggaggccgaggagagcggatcacaaggtcaggagatcgagacgatcctgactagcacggtgaaaccctgtctctactaaaaatacaaaaaaaattagccgggtgtggtagcaggcgcctgtaatcccagctactcaggaggctgaggcaggagaatggcatgaacccgggaggcagagcttgcagtgagcccagatggcgccactgcactccagcctgggcaacaaagcgagactccatctcaaataaaaaaaaaagaaatcaatctgctcaccctccagactgtgacacagcactatacaaggacaatcataggaccgtgagtcaaggagaagcagggtgagccttgtcagggcagtggcctcctcagcccacccagaacactcctaggccctaccaagcctcagggggcttgcacacacgggtcctcattgtcatgccttcactgctcagccctggtgcaggccaccactcgtaactttcggcttctatgagagattttatttttctgtctagggaaaacatatggcaaccaatgtaacttcaagccaatactcaagtgcaaagttgatgcctgctccatgccaggccatgtggtcaagagaaataaaacctactccttgccttcaacaagtcttcagagcgtggaaagatgaacaaggtggcaactatgagtgtggataccactatgttcagcgtgtgtaacaggacagttattacaaacaactacaaaagcaaagccaaatggcactttgagaacaacaaataaactctgcttccatttgaaagcaaaccaagaatcatctggttctctcttcaggaattctccaagaggctggatataaggtctcactctatgagtcagacaaggggaggctcccactcataaccacatggtcgtccccaggctgaccaaccagggaacttcagcagcccaagcactgggaagcccactgggaatccactttctctgggctttgaccccaaagacccaccagagaggctcccagacaaaggactgtcccagaggctcctgaccgggccaacaccatccaaaccctcatttggaaaggcaaacacctctaccagagacacgcataatctgatgaagaatgggctccagagatgatcaggaggggccccctctaaacagcattcttttctttttttttgaaacagaatctcactctgtcgcccaggctggagcgcactggcatgatctcagctcactgcaacctctacctcctggattcaagtgattctcctgcctcagctgggattacaggtgctcgccaccacgcccagctaatttttgtatttttagtagagatgagatttcacgatgtcagccagactggtctgaaactcctgaccttaagtgatcctgcctgcctcggcctccaaaagtgttgggattataaggcatgagccactgcacctggcttttttttttttttttttgcctttgagacagagtcttgttctgcagcccaggataaagtgcagtggcacaatcttgactcactgcaatctcctcctcccaggttcaagcaattcttgtgcctcagcctcctgagtagctgggattataggtgtgcagcaccacacctggccaatttttgtatttttattagaaacggggtttcactatgttggccaagctgatctcaaactcctggcctaaagcgatccacccacctcagcctcccaaagtgttgggttacaggtgtgagccttcgcaccctgcctaaacagcattctttacaggcaaatacaatctgaccagaccatctctgcttcttattttggaaccccccctcaaagaactaccacaagttcaaatgtcacctaatcccctacctaataccctggttggaatgaattggttttccttcagtactaagcctataggaattacagcacacctttcatgtcctaggccaagtcccactaaggaaggagaaaggtctctgccccctgggaactcatggtctggatggaaaaatcaagcctgggcaccaggaatggtgagaattaccaatggttctgatgctataagagagggacgaatgggggactggaagaagccaatctataaaatgagggaccacagacattctcccactggggtaacatctgagctacaccttgaaggatggtaaggcttgtctatgcagaaacagaacaagagaattccaggaaaacataaaggaagcacacatctacaagattattaatggggtgggcacaagaaacagcccagctgagccactgaaggggaagtagtgataaatcaggttggcaaagcagacctaaaccagcttgtgaaggagtctgcatgtctggccaaagcatttaagcctgtgattctcaagctggggtaagacacactttccccttagtggctttatcagcaccacctagtcttaaaaacgaattcatggatacatgtatatgtatgtctcacacattcacacacacatgcacaagtactcactacacctcccacccaaccaaagttgagaacaacggatccagtgaacattgttattcatggggtgccctgtattccttgagggtgctgaggcagaaaccaggtgaagaacctggttctccgatttagcctttttgtggcctttccatacatctttaggagactacataatggccaggagagaacctgtgagtgcaaagttccaggtgaatgagtgagcaggaggggagggcgtgccaaggccagtctaaaagagcacattcaggatcaagaggcacccacatccagagccaggatggggataaggtcagagaggtggccaaggtgccacccctcaggaggggttcacactcaagatcatccaagtccagggagtgcagcgcctccttaagtggagcctcctgggcatctcacgggcctccccacagccctgccatcttgcaagttctgggatctgcctaggttgggcacttattttttaaaaagacagaaagacagagagagaggaaggggtcggctcaaactaactttccaatgtgttaagacagcacacacctccacccctcacaagaggcacagtcacccagctacaacaaagagacaaggtggtgtgtaccccgcctactcaacacactcacctggacagttggcttcgtcgctctcatcctcgcaagtcgcccagccgtcacactgccaggggagggggatgcactggatggtgccgctgcgacacgcaaactgcccagggttgcaccgcagctctgtgggaccaaagggtgagaggccattgaggaagtggcagtaggccagcaaaccatagcccatgggctggatcaatctcttcccatttgtttgtttgtttgtttttgagacagagtctcattctgtcacccaggctggagtgccagtggtgcagtctcagctcactgcaaccttcaccttccgtgttcaagcaattcttgtccctcagcctcctgagtagctggaattacaagcatgtgtcatcatgcctagctaatttttatatttttagtagagacggggttttgccatgttggccaggctggtcttgaactcctggcctcaagtgatctgcctgcctcggcctcccgaagtgccaggattacaggcatgtaccactgtgcctggcccccatctgtttttaaaatcaggttttatcagaacacagccacaaatatgtattgtctatggctgctttcaagctacagcagccgagctgagtagctgcagaaaagactatatggcctgcaaagctgaaaacatttaatgcctggccctttacgaacctattacctagagataaaaactgtaacacttaagatgaaaagtacgctgcagaacattaacaggttagattttgtagtagaaaagattagtgacttgaagatataataatagaaacactctgaactaaaacacagaatgaaaaaataccaggaaaaaatgtgcaaatcatcagtaagctgtggaacaacctcacacaccctaatacatgggggaacagacacaacatctgaagaaacaatggggaaaatttcccaatttgatgaaaactataaacccacaaatccaggtagctcaatgaaccacaagcaccagaaatacaaacaatacaattccaagtcacattggaattgatttgcttaaaatcagcgataaaatcctaaaagcaggcagaaaaagaagacatgcacagaaaaacaaagatctagatgacagcagatttctcattagaaacgatacagcctagaagacagtgatgtgacatgttaaagttctgaaagaaaaagctgttgacctacaattatttaaagcaaacacacagatactgtattgtgcagtttatagcatacacagaagtaaaattttgacaatagtagcaccaaaggtgggaagagagaaacagaagcacactgttttaaggctctcaaactacaggtaaagtggtccatcacttgaaggtagtctatgataagttaatgatgaacccgactaaaataacacaagagttgtggcaagtaagccaacatagaagagaataaaaaataatccaaaagaaggaaaaaaaaaagacaaacagatggtacaaatgaaaacaaagggtaatatggtagattttaattaaacttgcctaatcaataaatacgcagaacgatctaaacactccaactgaaaggcagaatttgtcatgtagggaaaaaatcaagatacaactacatattacctaaaacaaactcactttatataggcataaataagagaaaataaaagaataaaaaagatataccatgttaacactaatcaaaggatagctggaagggcaggtacatggctcattcctgtcatctccataatcccagcattttgggaggctgatgcagaaggatcacttgagcccaggagttcaggaccagcctgagcaacatggcaaaatgccatctctctaaaaatacaaaaaattagccgggtattgggacaaacgcctatagtcccagctactcgagaggctgaggtgggaggatcacctgagcctggaaagttaaggctgcagtgagctataatcgtgctactgcactacagcctgggcaacaggagtgagactctgtctcaaaaaaaggctagctggagtgtattaatatcacacaaagtagacttcagtgcaaatattaccaggaataaagaaggtcatttaataatgataaagggattgattcaagaggacataatcctaaatgtttatgtatctattaaaatttacaaaagaaacttcaaaattcatgaaacagaaactactgtaactgctaatagacgaatccacaattaaagtcagagcttttaataaccctcttgatagaccaagcagatagaaaaccagcaagggctgggcgtggtggctcatgcctgtaatcccagcattctgggaggctgaggcaggcagatcacttgaggtcaggagttcgagaccagcctggccaacatggtgaatggacaggagttcgagaccagcctggccaacatggtgaatactaaaatacaaaaattagttgggtgtggtgatgcacgcctgtaatcccagcaacgtgggaggctgaggcaggagaatcgcttgaacctgaaaaaaaaggaaattacaaaagaagagcaaatgaaacccagcagtaagaaataataaagatgagagtggacattactgaaattgaaaacagaaaaatagagaaaataagaaaaacaaaagttgtttttttgagatcagtaatattaataaacctctagacagtctgatcagcaaaaaaaaataaagaatacaaaataccaggccaggcatggtggctcacacctgtaatcccaacactttgggagatgatccagcagatcatctgaggtcaggagttcgagaccagcctggccaacatggcgaaaccctgtctactaaaaatacaaaaattagccaggtgtggtggcacatgcctgtggtcccagctactcaggaggctaaggcaggagaatcgcttgaacctgggaggcagaggttacaggaagccaagattacacaactgcactgcagcctgggcgacagaacgagactccatcttaaaaaaaaaaaaatactactatcagaagagagatgtcatcactgtggattccagagaaagtataaaggctaacagaggagtgaagaataaggtaatagtatgaaaaactttatgtcaataaatctgacaatttggatgaaatacacaaattctttgaaagatgaaatgcaaagttcactccaaaataaataaacaatctgaacagccctaaaaggaattgaatttttagttaaaaatcttcaaaggaaactccaggcacaaatagcttcaatggaaaattcctccaaatatttaaggaagaattgatgtcaattctatacaaactctactgtaagttcaggtatttaaaaattaccattaacaatagtatcaaaaaataagaaatacttaggtataaatctaacaaaagatgtgaagtcctgtacactgaaaaattttcaacattgctgagaaaaaacattttttaaagacctaggtgcaaaggcagctccctgaagaaagaacaggcctttcaacagaatggtactgcgaaacacggaagaaagaaaaatgaagaggaggaggaggaggaaagaaaggaagaaggaaggaaggagttcatctacaaaatgaagttaaaaaaaggaggaggaagaggaggaagaaagaagagaagaaggaggaggaggaggaagaaagaggaacaaagaacaactactttgatccattccttgaaccgcataaaaaattcagaatagccaggcccagtggctcatgcctgtaatcccagcactttcggagcctgaggcgggtagatcacctgaggtcgggagctccgaaccagcctgaccaacaaggtgaaaccctgtctctactaaaaatacaaaattagccaggcatggtggtgcatgcctgtaatcccagctactcgggaggctgaggcaggagaatcgcttgaatctgggaggcggaggttgtggtgagccgagatagtgccattgcactccagcctgggcaacaagagtgaaactccacctcgaaaaaaaaaaaaaaaaatcaaaatcgatcataggcctacaggtgaagcctaaaactataaaactcaagagaagaaaacacaagaagaaaatcttcgcacccttggtttaagcaaatacctttaatatatctaccaaaaacacaatctataaaaaaaattgataaattggacttcatcaaaattgagaacttttgtttttcaaaagacatgttaagataatgcatagacaaaccacacacagagagaaaacatttgcaaatcatgtatctgataaagggcttgcttgtaaccagaatatataaagcatgctcaaatttcaataagaaaacaacccaattttttaaatgggcatgggccaagtgcaatggcttatacctgtaatcccaacactttaggaggccaaggtgggagcaacacttgagcccaggagttcaaaaccagcctgtgcaacataacaagacctcatctctacattacaaaaaaaaaacaaaaaaattagctgggcttggtgacacatgcctgtagtcccagctactcaggaggctgaggcaagaggactgcctaagcctaggagttggaggctgtggtgaactaggattgcaatgctgcactccagcttaggcaacagcaagacctccccaactctaaaaaaaaataataaataaaataggcaaaagatcttaatggtcacttaaccaaggaagatatatacagatggctagcaagcacatgaaaagatgctcaacgtctagtcattaaggaaatgcaaattaaagcatgaaaaggtggggcacggcggcccatgcctgtgatcccaacactttgggaggctgaggtgggtggatcacctgaggttaagagtttgagaccagcctggccaacatgatgaaaccccatctctaccaaaaacgcaaaaattagatgggtgcggtggcgggcgcctgtaatcccagctattcaggaggctgaggcagaattgcttgaacccaggagacagaggttgcagtgagccaagattgcaccactgcactccagtctgggcgacagaatgagactccgtctcaacaaacaaaaacaaaaacaaaaaaccatgaagagaaaccacttactagaatggctaaaatgaaaaagaatgaccataccaagtggtggcaagtgtgtgaagcaactggaactctcccagtgaaaatgtaaatggtacaacttctttggaaaacaatttgacagtttctttaaaaactgaatgtatacctaccatataatctgaccattccattcctaggtatttaaccaagagaaatgaaagcatatgtccacacaaagacttgttcatagtacttttatttgtaatatccaaaagctggaaacaaacagtgtctatcaagaagcaaattggtaagttgtgtacagccatacaatggaatactactcagcaataaaaaggaataagctattaacacattccgcagcatggatgaatctcaaaataattatattgagtgaagaagccagtatgtactcaaaagaatacctactgtatgacaacatttatataaaaatctaaaaaatgcacttgcagctatcaagacagaaagggatgggggtgggagggattacaaaggagcacgagaaaatgtttggggtgacgatacgctgtgtttgttatcttgactgtggtgacggtttcacagatttatacatatatgaaaactcaaatttggccgtgtgcagaggctcacgcctataatcccagcactttgggaggctgaggtgaatggatcacctgaggtcgggagttcgagaccagcctgaccaacatggaaaaaccccatctctactaaaaatacaaaattagccaggcgtggtggtgcatgcctataatcccagctattcaggaggctgaggcaggagaatcgcttgaacttgggaggcagaggttgcagtgagtcgaaatcacgccactgctcttcagcctaggcaacaagagcaaaattctgtctcaaaaaaacaaaaaacttggccaggcgcggtggctcacacctgtaatcccagcactttgggagaccgaggcaggcaaatcatgaagtcaggagatgaagaccatcctggctaacacggtgaaaccccgtctctactgaaaatacaaaaaattagccgggcgtggtggcgggcgcctgtagtcccagctactcgggaggctgaggcagaagaatggcgtgaacccaggaagcagagctggcagtgagcccagatcgcgccactgccctccagcctgggcaacagcgcaagactccgtctcaaaaaaaaaaaaaaaaacaactcaaattttacactttatgtatcatttattataagtcaattatacctcaataaggctttttttaactatcatgaaatagatttctgtttaaaaaatcaggaaacaattttgagatcaaaagatactgaccacaaggctaaaaatccaggcaccctgtgttctaggactagatatgcctggaactgaagaactaaattgaatcatggcccacctaacgtgcttgcttctctggaaaagacagccttggcctaccagatctcacccccgccatccatacaggagctaggtccttttcataattataaatccagggcttgccccatgactggtactgaagcactatttgatgagtaaatcagcaattgggacatgctcttctggcctaatgtctgtcttcctcagccacaattaaccattagaccaagaacctggaaccctccattcctcctcagtgtattctaggtcttcagttttattaaaaatttctaacttcttattattttgccataaaaatggaacatgaatggaactggaggacattatgttaagtgaaataagccaggcacagaaagacaaacttcacatgttctcattcatatgtgggagcttaaaaaaagttaaactcatggagctagagagtggagtagtggttaccagaggctgggaaaggcagaggtgagaaaaagaggttggttaataggtacaaaaacacagttaactatagttaataatggtttattctatacttcaaaataactaaatgagtagaatcagaatgttcctaacacaagaaaagttacaaatgcttgaagtgacagataccccaattaccatgatttgatcattacacattctatgcttgtatcaaaatatcatatataccccacacatgtaactactgtgtccataaagttaacaaaaaatttttttaaagactaatgcaggaaaaaggaaaaaaaaagccttctaatttcccaaactatactgagaaagagttcattcactgaatagagatttagcaacagaacattcttttttattttttagagatggggtcttactatgttgcccaggccagagtgcagtggtggctattcacaggcacaatcatggtgcctcaaagtcaaatgactctcccacctcagactacaggcctgagctaccccgcccagcagaatattttaacagtgtccattctattaaaaaaaaaaacaaaaaaaaaaaacaccctatggtgttgttcaaagtaaattcatagctcatgtcacagccctccaaatctacgccctaacatatcataccctaggcccagaaaaacttcaatgcactaccttaaattatttttggaaatagttgagtaagaagtaataagtaacaacactgggggttttctttctccatacccctatatcctccaaaagcaaacgtcagccaagtcttctctggcaaacaaggccccttcccccatgcaccacatccaccttgccttgccttggctgcttctaagtagtacttgtcactcctggcttcctatatatcagtatatagtaaacctatatatatatatacatatatagatatgtaagtgaaacagccaggtgcagtggctcacgcctgtaatcccagcactttgggaagccgaggcgggtggatcacaaggtcaggagttcaagaccagcctggccaagatgttgaaacctcgtctctactaaaaacacaaaaattagccaggtgtggtgcgggtgcctgtaatcccagctactctggaggctgaggcagagaactgctcgaatccgggaggcggaagctgcagtaagctgagattgcaccactgcactccagcctgggcgacagagcaaggctctgtctcgaaaaaaaaagtaaagcttcctgagggcacaggtcatgtctgcactgttcactcctgtgttcccagggcatagccgaccacacttagtgtccataactcaaacacacttgaagaatacttcttctctccatactctatgcatgtctgggaaaggctccaaaggcccaaacagccttcctctttgagaagtgcccatctggccactccatgagtgccacctgccctgccccaggctgggccaatgagaagagtctgtaaggtgatgggagtgggaagatccaggctagccagactgagacagtcacttgaagttctgtgcaccctgaggcagaaagaggtaagggctaagaccagaagggctgagaaaggggagcaacacccttcacagtcccatgaccccaaggatggctgtgcttcctccctgggctcagggaaaagttcctcctacagctactccttacaaccagacagctctggctaaaatagcccccacacggattttctgtccttttctttctttctccagacttttaaaaaaaaaatagttatcaaaagaggaaaaataagctatcagcagaatgactgtcttgctacatcctgaacacagctgggctccccactgctgggccttagtccatggcatcccctctccccaggtctcaagacacaccactctccaggaacccctccccaaactcccctaactgagtcggccttcttggcctagccctgttttcctaagcagcccttctctgttcttttcttcacaccctgagtagggtcagcacacttttccttcaagggccagatgataagtatttccaggtggccagcttcacaggccaccctctctctgccacagctgctcaaccctgctgccgtggagctaaagcagctgcagataatatgggaatgcgtgggcataggcatgtccaataaagctttagcgaaaaacaaaaaaaaacagtggccagttgcaggtatagtttgccaaaccctgttctcgagtatacatatagggacattttacatacatgtaaatgttttgttttttgagacagggtctcgctctgtcacccaggctggaatgcagcggcatgaccacagattactgcagcgtagacaccctgggctccagtgatcctcttgccccagactcccaagtagctgggactacaggcacataccaccatactcagctaattttttattttttatttttagtaaagacaaggtcttgctatgttgcccaggctggtctcgaactcctgagctcaagcaatcttctcaccttatgctctcaaagttttgggattacaggcatgagccactgtgtctggctgagggacacatctttattgctgccccatactccatgtcaccaacaccccacacatggaggcatgcactaaatgcctaatgaactgcacagctcaaaatcttcccatattctgctagcagacaatgaagtgtcagaagttctccaatagggaaggtttttctcccttcttgatccatctgtcaagccgggtctattctggaagcaactgaagatgtggatcactcattaacactggcacctactctgtgccaggcagttctccaggtgacagggctgtggtaatgaacaaagaaagtcaattccaggacatgacagagcttgcatccagcacagcacaccagatggtgactccaacaggtcaaactggcattgctttagctggacatcaacactgcgtttccactgactacgcgtggtgactcacgcctgttaccccaacactttgggaggccaaggcaggtagattacttaagcccaggagttcgagaccagcctggccaacatggtgaaatcccagctctactaaaaatacaaaacataagccagatgtggtggtgtgcatgcctgtagtcccagctactcaggaggctgaggtgggagaatcacctcagcctgagaagtcaagactgcagtgagtcacgatcacaccactgtactccaacctgtctcaaaaaaacaaaacaccaccaccaacaaaaaattgcctgtcctttctcaatatcctccacagtctctctgtaaagcagtaagtgcaacttctgccacatacaaagttgcttaaaaacagtcacccttggccaggcgtggtggctcacgcctgtaatcccagcactttgggaggccaaggcacgtggatcacaaggtcaggagttcaagaccagcctggccaagatggtgaaaccttgactctactaaaaatacaaaaaaattagctgggcatggtggcacatgtctgtaatcccagctactctggaggctgaggcagagaatttcttaaacccaggaggcagaggttgcagtgagccgagattgtaccactgcactccagcctggacgacagagcaagattctgtctttaaaaaaaaaaaagtcacccttgacccagtatggtggctcatgcctataatcccagcactttgggaggccaaggtaggaggatcacttgaggctaggagtttgagaccagcctggacaaggcgaaaccctgtccctactaaaatacaaacattagctggacgtggtggcacacacctgtaatcccagctactcggaaggctgagacacaagaatcgcttgaaccggggaggcgaggttgcagtgagccaagatcacgctactgcactccagcctgtacaacagaacaagactctgtctcaaaaaaaagaaaaagaaagtcaccccttttcactgatggctttacaaggtcctgtcccaggccttctggtgatgactgtcaccttgctgtagcatggcagaggcaggccagctcctcttagccaatggattgttgacactttatgaaacaatccatgcccacaacataccagccacagtaccaacataaggacagccccatcctggctaacatggtgaaaccccgtctctactaaaaacacaaaaaaattagccggacgtggtggtgggtgcctgtggtcccagctactcgggaggctgaggcaggagaatcgcttgaatccgggagacggaggttgcagtgagccaagatcgtgccactgcactccagcctgggcgacagagcgagactccgtttaaaaaaaaaaaaaaacctgccacatcagcagttcctagacttcttcattctaagacaccttaatacacttaaaattattgaagaccccaaagagcttttatttatgtgggttatatctgtcaatatttactgtatcagaaattaaaactgagaaatttggccagacatagtggttcacgtctgtaaccccagcactttgggaggccaaggtggtcggaacacttgaggtcaggagttcaagaccagcctggccaacatgatgaaaccctgtatctaccaaaaaatacaaaaatcagccgggcgtggtggcacgctcctgtagtcccagctactcgggaggctgaagtgggagaaccacttgaacctcggaggtggatggtcctttgcagtgagccgagactgcgccattgtactccagcctgggcatcacagcgaaaccctgtctcaaaaaaaacacttgagaattttttgaacacaagaatctgaagcacctgctcaaaggttttaaccttttaatagaattatcaaatgctcacgattccactcataggcatgtactcaagagaattaaaagcagagactcaaacagatgctggcacaccactgttcccaacagcattattcatactagccaagaggcagagacaacccaagtggccatgacagatgggaggataaataaatgtggtatagctctacaaaagaatattattccaccataaaaacaggaggcatgtagtaccccatgggcaaccaagtaatggtgtattgtgtcgcttcaaaagtaaatgtggggcctggcatggtggctcatgcctgtaatcccagcactttgggaggccgaggtgggcggatcacctgaggtcaagagttcaagaccaccctggccaacacggtgaaaccccgtctctaccaaaagtacaaaagttagctgggcgtggtggcgcacacctgtagttccaactacttgggaggctgaggcacaagaatcacttgaaccagggagatggaggttgcagtgagccaaggtcacgccattgcactccagcctgggcaacaggagcaaaactgttaaaaaaaaaaaaaaaaaaagtgaatgtgggccaggcatggtggctcaccacactcgtcagtaatcctagaactttgggaggccgaggcaggtggattacttgaggccaggagctcaaggtcagcctagccaacatagtgaaactccgtgtctactaaaaatacaaaaattagctgggtatggtggcacacgcctgtaatcccagctacttgggaggctgaggcacaagaattgtttgaacctgggaagcagaggttgcagtgagccgagatcgcatcactatactccagcctgggtgaaagagtgagacaaaaaataaaaaacaaaagtgaatgtgatcagccatcagccataaaaaggaagaaaattctgacacatgctacaacatgaatgaacctggacaacattatgctaagtgaaagaagacagacacaaaagaggcaaatagtatatgatttcactcataagaagtacctacagtagtcaatttaataaggatggaaagtagaatggtggttgccaaggactaggggtgaggagaatagggagtattgtctaatgggtatagtttctgtttggattgacaaaaaagttctggaagtgggtaatggtgctcgttccataacattctgcatgttcttagcactgctgaattaaccgtacacttaaaaatggttaaaatggggccgggcgtggtggctcacgcctgtaatcccagcactttgggaggctgaggtgggtggatcatgaggtcaggcgatcaagaccatcctggctaacacggtgaaatcccatctctactaaaaatacaaaaaattagccgggcatggtggcgggcacctgtagtcccagctactcaggaggctgaggcaggagaatggcgtgaacctgggaggtggagcttgcagtgagccaagactgcaccactgtactccagcctgggtgacagagcgagactccgtctcaaaaaaaaaaaggttaaaatggggctgggcatggtggctaatgcctgtaatcgcagaactttgggaggctgagacaggaagatcgcttgaagccaggagtttgagaccaccccagacaacatagtgagacctcatctccacaaaaaatagaaaaatttgccagacacggtggcatgcacctatggtcctagctactccggaggctgagataggaggatcacttgagcccaggaggtcagggctgcagtgagttatgatttgattgcaccactgcactctagccttgacaacagagtgagaccctgtctctaaaaaagataatatggtaaattttatgttacatatatcttaccacaatttaaaaaagaaatgaaatactaacacatgctataacatggatgaactgcgaaaacataatgctaagtgaaagaagccagacacaaaggacaacatattgtatgattccattagtatgaaatatctagaatgggcaaatctatacagacagaaattgccaaaggctgtgggcaggggaattggggagttactgtttaaaaagtatagagttaccgtttgggatgataaaaaaaaaaaaaagttctggaaatgggtagtggtgctggctgcacaacattctgaatgttcttaatgccactgaattgtgtacttaaaactggtaaattgtatgtgtattttaccacaataaaaaaagttcttttttttttttttttttttttttttttttttgagccggagtctcgctctgtcacccaggctggagtgcagtggcaagatctcggcttactgcaagctccgcctcccgggttcatgcccttctcctgcctcagcctcccgagtagctgagattaggcgcgcaccatcacgcccggctaattttttgtatttttagtggagacagggtttcactgtgttagccaggatggtcttgatctcctgacctcgtgatccacctgcctcggcctcctaaagtgttgggattacaggcgtgagccaccgtgcccggccaaaaaaattcttaaaaaaaaaaaaaaaaaaaaaaaaggccaggtgcggtggctcatgcctataatcccagcactttgagaagccaaggtgggagggtcacttgagtccaagaattcaagaccagcctgggcaacatagccagaccctgactctacaaataaaataaaataaaaattttattttttattttattatgaggtgagagtacctcttgaacccaggagttcaaggttacagtgagctatgacccagccactgcaatccatcctgggcaacacagtgaggcactgttctttcaaaagagagagagaaaaaaagagagaatcccaagcatacatcccattagctgtcagagcaatgatgtcatcacatatcaaatagtgtctggaaatgctaccttatgcttgtgaggatgagagaaaggcaaatgacacctcagtattatcatgaaaacagttttgacctcacggagcccctagaagggtcagggaacccccagagacccctgggcacacttggagagctactgctttgggctatgcaacgcccaggaattagtggattcatgccctgtagaaacccacgagtctctgcaatacaaattctttctctagattcaatttctcctttgtcagcaagccttagccttgtttcaaggctgtctcaaactgagctgtctcaaattactgtgtgaaatttagtatgctgcataaattgtttagaattgatttctcttcaacatttgcccacaaagaacaagagggagacagagtactagcagaagcacacatgtccacagttacatcactaagaaaatcaaaacatttccagcaaagaaatgcaggagaaattccagcccatctgctcgcactactcacagcccactaagataggtctccaccagagcagtctgagacccatcagacacagactcccacacccggggtaggggacacccatgccctgctggagtgcccagaacagaaggttccagcatccctggcaggcctgctcacacctggcagtaaagccttactgcacattctgtcttggaaagagctggcagctgcttcccagtggggctttcccacaggtcatttcaccttccatacaagttgctactaggaaagggagatttgtccagcacacttcaaagcagcagcagcagcagaggggagaaggtttggaagccaagggctggctgggctattgtaacaggcgaccacgcatctccaggagaccagaggtgtggatgctgggttctgccctgggccagccatctcttctccagatgccctcaagaagggacagagggccgggcacggtggctcatgcctgtaatcccagcactttgagaggctaaggcgggtggatcaccggaggccaggaattcaagaccagcctggacagcatggcaaagccccatctctactaaaaatacaaaaattagctgggcgtggtggcgcacacctgtagtctcagctacttgggaggctgaggtggggagaattgcttgaacctgggaggcagaggttgcagtgagccaagatcatacaactgcactccagcctgggtgacagcatgagactccatctcaaaaactaaaaaaatagggaggacagagaccactgttgatagcacaactaaaagacaaaacagagggcatattgctcggtgaccttctaaatggaggggtcacctctgtcctgaggcaagagtgaataataagggccttgaatggggcctcagagatggccagcatctgagccaccaggggccatgggcaggcctctggcaagcacccattctgaacaggtgctgcccagtggggaagggagcgatgcacgctctggaaggcacactgtactccggggccccagagggacttcgggaccagatagcttcatgggatgtgctataactccagaaagggacgcggctggcgatggaggagtgcatcatcagaacaccaacctgcgtcagacagagagcagacctgggagggcagagctaggaagtgaggaaaggcaggacctggcattccaaacagtgcacagaccatcccagaaccaactgtgatcacatcacaaactccctgccttctctacagtgctcaaatgccatctgcccttttatggagtccaagggccacctctaaccttcccgcaaagccccacatccaggttcttgggggtcccggctcaccagtccctgcagctctcccctgaagcccgtctagccccttccccatcgctgccactgccccgtagcaccagcaggccagcacacaacctccccacccctgtagcttcctggaaccacgcagggagactggcttggaaagacgccccagagatccgttgcgagacaaacagcaggcttcagctcctggcccgtgcaaccctgctcagcctcgccaggctgcttcctccatctgtaaagcatggaggtgaccatcctgccctgcctatccctcctgacttccacggaggtgatgaggcccaaaagagaaaattactccaacaatgctcagctgctgaagtttcacatatgccacccttaggaacaatcctgggaggtcctctgcagagataaatgctctgagagggacccacaagggcaaagagaggatgggaggcaggaaccatggccaggggttctgtgcagtttgacctgccactgcgtctcagcagcagggggcagtgaagactgctgatacctggaggcctgagcatcctctgtactggcagccaccaggctacagcaccaacgatgccagcatctgaacctcaagccacaaggagcccagaggccagccggctcctcacccatgagggcccagagttcaaacgggaacaagacatgtgtggctcatggaaaatgatgagattggaagtttcattagcaaaatgtgaaggaaggcccgaagctgttctatgtattgaaacccccaactagtccagccagctagcttctcagaggggctgacccgcctactcagtgtcccacatcaagttggcagcagcagaatgggcatcagaggtcaggctgtgggctctttgacccaaatccccatccctgaagccagcagagcccctgggtggggctctgcattctgactccctagaggaccaggtccaaactttccagttctgagccatttccttcaccgagacagcagtcagcagagcctctgggggctcactgcacaaagcccagggataccagagccccaccaccagtctggtgcagagccaaggatgtaccaacatattgtactttttttccctaccagtggccagttactagaacaaaatattttacacctgcaaacactcctgctgtggttttgaaatatgcctgcaacttctttgatatggctccctaaatggcagtagctccccaaacacataaccaccaaacccatttccaaacagcccccggggcaagtggaatctctgagtgaaggctccaccctcagtcactcctcccctggaccctggagctcctgactccccatcaccaccactggagacaggtggccagctctcctgcaacagtggagagggagtagggttgccaagcgctaggggagtgccagccactttctcccacagcccaaggggtcacaacactgacactggggaacaccacacaagaacaaagggacaaggcctatgcttcagcatttatttctcataaataacaagcattttctacctccaggagaagaagtgatcaccacctgctaccatctatctgtagatgctgtccaaccaaaacactggctcagctgctctgccctgtggcttctccttaggcagatgtttgggaaagaaggccctgtttaaaataagttatcctagaaaagaagggaaggtcctaagaaaaaggaagggatcatataagatgaaagaagagaaaggcaggtccaccaagcatacctattccatgagtgacactttcaagaaaagaacagcaacttgcaatcagtccttatttcatgggggttcgggcaggaggggctacatacttgggaataagaccagggcaggagggtgggacagaactggagcgagagctatctcgcatctgatgtaaacatcagccagcagtttcatccaacactcgcaccacatttcgatcatagccacaggatagcgcagccaatttctctaagagaaagaacagctgtagtcaaatcagattcctgaatgctcattttgcatgtgccaggcagtatatcaagtgcttagaatacattattatgaatccttaagacaactcatttgctccttccatgaacaccgccgtgtacctcctaggggccaggtgttgtacaggacacaagtgagaagagcaggaggagaaccataaggtgtctgcccccacgaagctcagattttactagggaaggagaagaacttcgtaaccttggggtaggcaaggatttattagacaaaaacagaaagcatgaccataacaagaaaaaatgataaatcagacttctttaaaattaaaaaagtctttgatcaaaagcttagtaaagatacacagaccacactgagcacagtagctctcacttgtaatcccaacactttggaaagctgagacaggaggatcacttgagcccaggagttggagaccagcttgggcaacacagggatccagtctctacaaaaattaaaataaaaatattagccacatatgatggtgaacacctgtggtcccagctactcggtgagggtgaggtggcaggatcacttgagccagggaggtcaaggctgcagtgagctgtgatcccaccactgtactccagcctgggcaacagagaatttatctaaaaaaaaaaaaaaaaaaaaaaaaaaaaaaaaaaagatgcacaggccaacagaacagaatagaatacagatctcagaaatagacctacacaaatgtagtcaatggattctgacaaaggtacaaagacaattcaatggagaaggtataacctttcaacaaatggtactagacagttggactccacatatcagaaaatgaacctcacactttgggaggcggaggtgggaggattgcttgagcccaggagctcaagaccagcctgagcaacaaagtgagatctcatctttacaaaaaaaaaaaaaaatcaaaaaattagctgggtgtggtggcatgcatttgtagtgccaactacatgggaggctgaggcaggaggatcacttgaacccaggaggtcaaggtttcagggagttacgattacaccactgcacctcagcctggatgacagagcgaaactgtctcaaaaggaaaagaaaaaaaaaacctccttaatcatcagggaaatgtaagccaaaaccacaataggctatcacctcacccattaggatagccactgtcaaaaacaaacaaacaaacaagtgttggcaatgatgtgaagaaatcagaactcatgtacatcgttggtaggaatgtaaaatggtacagtcactatggaagacagcatggagtttccttaaaaaattaaaaatagaattaccatatgatccagcaattccaattccacttctgggtacatacccaaaattaattgaaggcaaggtctcaaagatatattcatatacctatgctcacagaagtactactcacaataactaagaggtggaagcgacccaggtgtacactaaataaacaaaatgcagtatatgcatacagtggaatacaactcagccttaaaaagaagttctgacacatgctacaacatggatgaaccttgaggtaaaataagccaaacataaaaagacaaatactgcatgattctacttatatggagtatctaaagcagtcaaactcttagaaacaggaagtaggacggtggttgccaggctggagagagagataaaagggaggggtagttactcaataggtactgagtttcagttttgcaagatgaaaacattctagagatctgttgcataacaaggtacatactctggcactactgaacactgaatgaactgaacactgaattgagtggttatgatggcatattttacgttattaaaaaaaaactgcggtagcagtggagccgcctaaccctgaaaagcacatataaaatacggagggatttaaagtcctaaggataatattacaactgaatgaagtaactcctgcaagaaagcaagactagaaatctgacgcatctaaaaggagactgagcctacagcccagccatgggcaggcagttctgcccagttcctcccttgtctaacagagtgggtccaaactttagtgtgatcaccacagggagttacactcacaaaaagcacatgtcctatcatatggggtctttaaagaacattcaaaggaaacatttgcagtctgaaagcttcatttcctgctcttatttcaaaacctaagttgaacacaagatttaacacacgaaaaactctatccaaaaaacggggttacagttaaggttaatggagctattacatgccaagtgctgatgagggtgcctgatgctcagaaatggggatggggtggcagtgataagacagcatcagctaagaaccaaggcagggactgcaggaacaggctgcggggaagtgtcagcttcctgggggcatttgtgtggacacagcaggggtgggccctgaggagtcagggctgcggcacctggagcctgctgaagctatgggaagaagacaagaaaagcagggtgggtgggaaggttcacattgaaaaggcgggaggagagcattaggacaaatacctaatgcatgcggggcttaaaacctagatgacaggttgttaggtgcagcaaaccaccatggcacatgtatgcctatgtaacaaacctgcatgttctgcacatgcatcctggaacttaaagtaaaataaaattaaattaaaaaaaaaaagaaaaggcagaaggagaaagacaaggagtagatggaaaaagagccagagacttctcttgaagctgtgcaatatcacagcatgaactctatgctgcccatgtttcaaatacccactccatgactttaaaagctgtgtgactttggctaagtcacttagtctcccaagctctgtttctctatctgtaaaatgaggttaatatgagtaaacctacttcctataaaaagacatcacatctcatgctgcaattataaagcagaaatatgcaacagcattaagctaaaatttcatttaacttttttgtgggttctaagcattttagatctattttttctgttaagtagtatgttttatattcagttatacacatttttttccttttaaaataccttttcctcatcttttactttcatgaatgtttgttaagaagtaatacatccacacggttgaaaacccacaaagtccgtccatacaaaagaaggtgacactctaataagcctcccaagcttctggaaacacacaggtagatttgattgcaatcactgtgtggtgagatcacagagggtggtcaccagctggcctgaattgatcacccaagcccaaagagacatcacagcatcagtgtccacacaagatgctggtgcagtcagaactgtgaacactagcgatgcccaactcagtgaaaaggtgcccggttcttaggcaggaggccccaggtggtggcgctccacttagctccctctgccatacagctctttcatcagcttttggaatcatggtgcaggaggcaaagcatgtggctcaggatagcagtcctgagtttcctgttcttgcttctacttaaaagctaagtgatgccaccaagcaagctaattaacctctctgggtcttagcatcctaatctccaaaacagacctaccacctgcctcactgatcacccctccacaatgagtcttgtcaggtaaagggtgtgtagaactatacccaaactcccaggccaacctcagcccctgcttcagacagctcccccataccactgcatacccaaagactatcagagcacgaacccaagctatcggatggagaggaaacacaaagggtgatggctggtggaatgagaccctgttaaaccaacaagctcacaatgtcagcacttgggcccaaatagcccttgaacatctaaactcttttttgtttttattttttatttatttatttttttttgtctccaggaagaaactgaaacttaaaaagtgatttaccaagagttttgacaaaagtacatcaacgaaggctcaggactgtcagaaatgaaaaataattatttttaaaatatctatttattggctgagcatgatggctcatgcctataatcccagcactttcagagatgcaggcgggtggatcacctgaggtcaggagttcaagaccagcctggccatcatggcgaaaccccatctccactaaaaatacaaaaattatctgggcgtggtggcacgcacctgtagtcccagctactggggaggctgaggcaggagaatcgcttgaacccgggaggcagaggttacagtgagccgaggtcgcaccactgcactccagcctaggtgacacagcaagactccatcttttaaaaaaaaaaaaaaaaaacctaggaaaataataaaaccgttcaaaattgagatgcttccttaccaattagtgtaatgaaagaggggcttgttataaatactgaggttacagtaaataccactctcaatattatttaataaacatggtttcaaatcaaaacaggttttttttttggttttggtttttgaggcaggtcttgctctgttgcctaggctggagtgcagaggcatgatctcagctcaccataacctctgctcactgggctcaaacgatcctcccacctcagtcccctccaagtagctgggactacaggcgtgtgccatcatgcccagctaatttttgtagtttttgcagagatgccatattgcccaggctggtttagaacttctgggctcaagcaatccacccacctcagcctcccaaagtgctggaatttcaggtgtgaaccacccggccctgcctcaacacagttttgaacctaactgtgtaacaatcacatggaagagagaagagaattaatccaagtagcttttgaacccaagaaccttgagtatacaccatcaatctgaaaacacaaagagctaaaaaaaattaaattaaattaaattctacttaataggtctgctgttactagtggtgcgaatgcagtacttctgaaactattctgggtgcagtgtaagactaagcaaatgagtaaacctactgatgctgttgggagccagggttctcactgtagaaaaagagagaaacaaacatgcaacagagaaagcaagcaagaacctggaacgctggattagaactaaagaaacagtatgggccaggcacagtggctcacggctgtaataccagcactttgggaggtggaggtaggcagatcatgaggtcaagagatcgagaccatcctggccaacatggtgaaaccccatctttactaaaaatacaaaaattagccaggtgtggtggcgcatgcctgtagttccagctacttgggaggctgaggcagaagaatcgcttgaacccgggaggcggaggttgcagtgagccgagatcaccccactgcactccagcctggcaacagagcgagactccgtctcaaaaaaataaaaataaaaaaaaaaaaataacagtatgaacttacacaggcacagacacatgcacgtatgcacacacctcttgggctagactgaaaagatggagtcgcagcatactctagtagctagcaataaacacatctaccaccaaaatcctgctttctaaataccatctcccaccaaaaggaaccagcgctctgtgggaaaatgccccattccagtgtggggcaggtaaggtacaagatgtgcctggtaaaaaggaatttcaagttgatggaaacatgtcagaaggcgacacgctcccatcctgaaaaggccaggtgaaggggtttccacttgccaagtcaacctactgttatgtaggtttgaaatatttccaaagtaaaaagatttctaaaaaagaatgagttaggccaggcacagtggctcatgcctgtaatctcagcactttgggaggccaaggcagacggatcacctgaggttgggagtttgagaccagcccagccaacatggcaaaatcccatctctactaaaaatacaaaaattagccgggcatggtggcagacgcctgtcatcccagctacttgggaggttgaggcagcataatcacttgaacccaggaagtggaggttgcagtgagctgagattgcaccactgcactccagcctgggcaacaaaagcaagattccatttgaggaaaaaaaaaaaaaaaaaaaaaaagaacgagttaagacaatcttgccccgacccattcccacctttcctctccatcttttgttaccaaaggaaaaaaaaaaaaaagaatgaagttatatatgcactgatctacaaagatctcaaaataagttaaatacaaaaattaaataaaaaatataattccatttatgtaaaatattctatgtatgaatgttagcaaatgtgaagaaatatcaactttattttttctagattgtccagacaagatcttctacacccttgggctctctccatgccccatggcttaccatgctggtctagcaggcatccttcgcaaatagggtagatggggaaatccgaagagctgctcccactgtcaggagtggccaagaaacctccaagaactgcagcaaaggcctgccatggcccccaacaagcctctaactcttccaggtcctcttattctaagaccatagacagagttctgtaggtaaactaatctacctggaggccctaagaagcagccagtggcaccggagagacctctgcatcagcagacctagtttcaatggagcatctggcccggtcctgtggtcagtctcctgctgatcatccctgtgttgaccttctgggtccctctgctgtgactcctgcccctcatccagtgccctggccagccacaaacaatcctctccacaactatgaactcctaaggaaggtttcccagaaaatgagacttcccaggcaaggaagagggcagggtctacctgggggacccttagtccaccatacccaccagaatactgtcctcagtactgtcctgtccaacagtagcagccaacagctgaaggatgacagactaaccaaggaagacaagctaaccaaactgatagctgtctgccattttgccagaggtcagccagaagtcagcctacagggagggacctgtaggggacaagggcactaagaacaatgaccagctcagagtgactgaagcaacagctaccgcaggcagaggaggaggagaaggccaagaggcaagcatgtgcagcccatgcagcccatgcacccagccagctcttgaccagaaacaagccctgcactgtgcaaacaacccagggaaggtccagccacatcctcacacagggcagtccagttctcaaagccaggtgccagcaagtccatcagagaggcagctccctcagcaccggcttgctggggtccctccctctgggagcccctcaaccctccaccccaggctgggcagctggtgagcttcagtgaggatccacattaatgagaagccacacttgctctcacctctcagctcagctcccatcacagaagcaagctcctaccagggtggggcccaggccagctggctccacagccatgtcccctacccccggatcccatcctcccaaggcatttttgcaggactgccacaaggctctcatcctcctcgccacccccaccagaggcagctgcaaggcctgctggctaaagtagctgttgctctttatgtcaaaatataaataggcatttgtgcatttgttcaataactgatttctgagtgcccagtctgtgcctgaccaggcccaggtgacagagcatgaatgtgacaaagagcaaaacgtgtatgaacaatcccagccctgtccaaagcaccatggctgtttcgggggctctcagcaagtcatacgcagtccctctgatcccatcataacagcaaagagcactctctgtgtggcagacactcctcagagccactgtactctgccacctcctgagggagctctctcccgaccaataagccctgtgcacaaaccacctcacatttcacatttcagttcagggttcctgaactctatctgtgattaacactaacattttgcctgatgaagagtttgctttatgtcagacactttttagaattttatacttacccattttaatcctcacaacatctctataaagctctgttacgatgtccatgttccaaatgaggaaactgaagagtgagcagtagaacagattgagcctaggcagtgtggctctagagcccatgctcttaagccaccatacccaactgcctgccatgggccaggatgagaaggcttgatctaatcccagctgctacttttacagacagctcatttgaggcaaaaccagacctgagcttccccatctcccaggaggatgcccagaaggtccagggcatctgggtccacaggctattcaccctccaacctagacttgccctgccaagcccgccatgtccacactgacaggacacacagcttggaatggcaggatgagatggactggctttgactaaacttcccaggacaactggtaaatcatgtcagaaacacaaatacaggtgttacacagctatcacataataaccatacccaagcccatgcatcactctgctcaatgaactgttggcccaaaactggtctctcgggattaccgagcccactctgcagactggcagtgaaagaaaggaaagaggacggtcatcaaaacctcagcacccaaacataacagcacataagagaaaatctaatagcataccaaggaaaagacatctaatcagtcaagagctatctacggggtccttaaatgttgtcactgatgcattccacttagagtcaagaaactactaaatgccaatcgggtcgtccttatgccaacaaccaagagaggcagaggaactccctgcctgtcaaaggctcaggtccagcaggagagagtcaataactagatcacctgccatcagtgttgagaggatgcatgcactactagatcacctgtcatcactgctgagaggacatgcacacaaccggatcacctgccactactgctaagaggaaacatgcataatgagatcacctcccatcacctcccatcactgctaagaggacacctgcacaaccagatcacctcccaccatggctaagaggacacgtgcacagctagatcacctgcccttactgctaagaggacacacacagatcactcacctcccattactgctaagaggatctgtgcgtaacaagattacctgccgtcactgctagaaggacacctgcacaaacaaatcaccggccaccgctgctaagaggatataatcactcagtactctgggaagtgggaaggaaggggtggggaaagtgcccacaagctagcttgggaagtggagcagcgaaggcgcagcctaacacagcacaaatcttccacaacagcagtcttcattcctaaacccagaaccgccaactaaaacaataaccctgacatgcagtgatgccagcttgcctccacctgggccaacctgggctttaactacagggcttcctgcacccatgagaccttcccacgtgacacagggcttggcacatagcaggtgttagtgagaacgatggggtggggttaagtgggagcagcctctactctctgcaatggttaacatgtacaaggataaacggccatggcgcatacaacttattctcaaatggttcagaaaaaagcaatgtgtgtgagtacacagatatgcacatacacatggaagatgagggataaggcaaataaggtaaaatgccaacagtagggaagcctcagcaaaggatatgcaggtgttctctgcactcactttactcttgcaacttttccgggagtttgaaattatttccaaataaaagttttctttttgtcaagaaaaaaaaggaaaattcattagctagtgaaggtagaaagtatattacatcactttccaactaaaaaaaatgaacctgttaacccaaaagccaaatctaccagtggacaaactctacaaagtgtcacagtactggctacagaggaaagcactccaaactcaggaggatttggcaaggctaggtgcaagctcacctctccagctacttctgaacctcggtcacttttccttgtgatgaaaatatgcactctctccctatgcaccaaacccctgtgctacttcacatgaaagaaaactctggactccagccggggagaggtggctcacacctgcaatcccgtaactttgggaggccaaagcaggtggatcacttgagcccaggagtttgagaccagcctacatggccaacatggtgaaaccccgtctctactaaaaatacaaaattatcccagcatggtggcgtgcgccgtaatcaaagttactctggaggctgacacaggagaattacttgaacccaggaggtggaggttacagtgagctgagatcccgcaactgcactccagcctgggtgacagacagaaactccatcgcaaacaaaaaaaaaaaaaaaaaaaaaaaacaactctggactccagagccaaggtgctgtgttcacttctcagctccctgagatgtgatcagctcagcacagctgcctactgaaagcaaaagagaaagaaccctgagctagcagccagctccacctgggtctgaacccacgctctgctgctcaccagctgtgtgaccttagacaagtcacttgcctctcccagctagctgtaccaacaatagaaggaagacgaccttctagtcctctaccttaccaaggggcctagctgagcacaggccctgtacaggaccaacaaccagcaggaagggaccagggtgcaccagcattcagaaggcaattttttctcagctatgtatggtgggttcaacctggatagagctgtggctcatgatataattttgtttcacaattaaagctagaaagaaaaacagttttagaatcagcagtcgatgctgccttctctacacagatggagaaagggccaatgagacagtatcacaatcagtggtccccaaatccccccaccatctcgctgtcagttacctcagcagtagtctccaaccgttcttcctcatcacacccccagtgatcataacacacatcatcagtggtcacatggccaaacacagaagggatttggcagagggtgagtggttctgtccctcagactggagtatccacatggaaaaagattctgcaccctcacctagaggaccctgggacctaacaggggacagaggcagtctgtggctccacctggggttaaggaagctgttcagagcataatatgaggtactcctgtggctgggctggagacacacagttggagtgcacagaccccagtcacgggtgcatgatggggggaaggccagactcctacgatgaaatctcatctcagccttagcttcatgagtgctctggatttcagcttccccatctttaaatgaggctaaaaacagcatctagcagggacctcttgagagttaacatatgttagtgcttagaacagtgtccggcacatgacacatcttaaatcaagttcaaatgtgcacttaaaaaaaaattgctgggcatggtacctcaggcctgtaattccagcactttgggaggccaaggcaggtggctcaccagaggtcaggagttccagaccagcccggccaacatggcaaaaccccatctctactaaaaatacaaaaattagccgagcgtggaggcgtatgcctgtaatcccagctactcgggaggctgaggcaggagaatcgcttgaaccaaggaggtggaggttgcagtgggccaagatcacgctactgcactccagcctgagcaacagagcaggactctgtctcaaaaaaaaaaaaaaaaaaaaaattggtgaaaggtcaagtacagcaagcacttgctgccccataactccatgaaaggccttccaccctgccctgtaccagagaggaagcccaggtggcttggcatcatcttcagggaccccaccaggcaggagtcagaaaacaccctcctgagaagtgggctctgactgataccttcctcatactcaagtatgcttttaaggccggaatccccacagaaagaacgcagactaagaccagagaagccccagcctcttgcaagcaccagccaggcagatccctgcagcactctcaggaaggacacatggtgaatgtgtgaagaggcacacacgggcatacaaggaacacatcaggcccagaggcctgccctccctgcccagccaaagccaggaagccagctgcagctcccgggttctgcagggcaactcaagacgcctccaggggtagctgcaatgttctcatctggagagtcatggaatcgaaagaataagtttgctccctctaccagatccaccccacccatgccctactccgacctcagtgtgaggtctcctgtgacgccctcactgcttcacaggtacaaaaagatggccacctccacccacctctgggaccccacactccagggtattcaacacacaggagtgtgacaagtgacttacacctggcctctgttccacatcaggcactcctaaaaggaggggcttgttcttgtcacttggattccctagggatgggcagggggcaagcacccacaggcactttctcagttgctgctggccagttggcaggctatgtgaaaaggctggcaaggaaaaaggagtcggggacgtcagtcacctctatcacccaggcaggagatgctgggcctggaaccagaggcaccccaaagaagccaggcataatatggcctcacctgagcccggtgacctcatctgcaaaactgggactcaagaatcagaaaacggtgaccttctacctctctacacgtacatatatgttttctaaagaagttaatcacaagaatccacaaacccattggttctgacctccaagagcctatatgataccctcctccacaggtagcccttttcctggcttctgttcttaccaaggccaccccacaactagtcatcccgctgcccagagagcagccaaaagcagtgagcaactagctctacatggggagaccagagaagcatcactgaatctgtccaggttgagcaccggtcagggccttggccaccaggcaggcactagggaggaggcagacattccacatagatgacacaagcgcagagccaagaggtgcggtgtatctgggctgggagcctggctagggcacaggagagggccacacaccccgtgctcccacacccaggtcatcagagaagatggccctggcacttctgccttcatgggacctttcctccattaagaaatattaagagtcatgctttttcactgtattagtataaagatgactgtattaatatacatacgaaaacattttatttgacctaaaagttcattttttttctgctgactttaaaaaaaaataaaataacattcgaaggctactaaaagtaccgtgggcaagtgataccaggattcctgtgcctgatggatacatcggccctgcatttagggagtttgattttttggtgcagttcaaggggaggtacaccgaaataggtagaaaagggtctcctggttgccacggttctgattccccaccacagacttaagaacacactagctccgaggggagttccaaagcacggactcattcatcacatacacgcagcacggctaagggccccgcacagtggcgaggtctctgctcccgggacgctcgcgccggccacacaacgctaggctgactcctggtgcctcctctaggcccggtgggacctgaggacttccttagcgcaacgtctcactgaatgacagccacaaccaccgctgtccaggcgaggagtttccaggactgagaggctggcactaggccactgctgggaggacgtctgtgaaaccaggtgcccctgagagccactgtccccagcccgactccgacgctggactggcgagagggtgcgcccgtggcgtagctcctggccgccgccgctcccgggaagggcccagaggcaacatcctggacagcagagctgcacgaagtccgaggcgccgcgagcccaggtaagctccagcaggcgtccgcagagagtgccaggcggcccgcgagccaggccccgcccgcccctgccccaggcgcggcccctgcaggagggcgccgcgggtgaaaggaggtcccggggcgaccccggccccgctcgccgcccagcccccacaccgcccccatcgcgcggcgcacctggccgcagcggctcggtgacagtgagcacgagcaggaagagcagcaggaaggcgccgctgtctgccttgggcaccatttatcctccgttcatcgtccccggggcggctggaaggccggaccaggccggactgagggtcaggggaccgtgccaagcggagggtcaggcggagctgaacctgggcgaggcgcggagaggcggcgggaaagagcttcggctgggccgcgggctggcgcacactctcggctgcaacctcaggcaccgactccagctgcgcgcaagatggcggccgtcctgctcggctccgcgccgcgccgccccgccccgcctcccgcccgcgacgcaggcgcgggccaatgaccgtcaagatggggggcggggccagagccaaagccctccgaagagggtgaggcctaaggtcgcgacggcggagggcggggacctaagggcggggactgaggggcgggctctaagggaagggcgggaccatacggagtgaggcgtgccattggttaagcagagaggcagggccggggccggggcctgagcggcggggccaccgaagggagtagggtctctggacgccggttagggacggcgggcgcgggacggcaaggatggacatcgaaaggcgcggggcatggggcggggcgccgaggggtcgcgcgggtggggagcggagagaacgaagtgggaacctggctgggactccaagggtcttcacacctgcaagctcaggtcccgtgagcagcccaaaagtgcgccccaaaggggtctttttaaggccgaaccgctgtggaggagggagggcctgccggttctgagggtggggaaagaggaacaggaatggcctaagagagtgtcaggcaaagagagaccgggaaggccaggtcctggagactgcagcgaagccggctccctggaggacctgcctacacaatggctaggggaaggccacatgtgcaggaaagaaagctaggcagagaggaggctcagcgcccctgcgaacagtgctccaagtgccacttctcccgtcatcaccaacagggtgaaccttggagggcagtgtcggcgaagagtccaactctgtaaaatatttgaagacatttcttctgagccaatatgtgaccaatagcctgggacacagccccaggagatcctgacaagtgcccaagggggtagggccacagcttggttttatacattttagggagacaagacatcaatcagcacatgtaagatatacattggttcagtcggaaaaggcgggacaacttgaaagtggggggtggaggggggcttctaggtcatgcggattggcagttggttcaaagagtttatctaaagacctggaatcaataaaagggactgtctacattaaggggttgtggagaccaagtttcttaggcaaatgaagcctccaggtatcaggcttcacagagaaaagactgttaatgtttcttattaaaaagtgccagactctgccgggtgtggtggctcacgcctgtcatcccagcactttgggaggccaaggcgggcggatcacctgaggtcaggagttcaagatcagcctggccaacatggtgaaaccacatctctactaaaaatacaaaagttacccaggcgtggtggcacacgcctgtaatcccagctactcaggaggctgatggcaggagaatcgcttgaaccggggaggcagaggttgcagtgagccaagatcatgccactgcactccagcctgggcaacagagtaagactctgtctcaaaaaaaaaaaaaaaaaaaaggaaaaaaaaaaggaaaaataaataaaaggtgccagactctagttaattctctcaggagaaaagaccttgaaagggatagggattctctacagaatgtagattttccccacaaaaaacagctttgcagagcgacttcaaaatatgtgaaagaaacctgttttgcagtaaaatatgtgtttccttccgggcctgctgtcatgctggtatcttactgccacagagtctgttgtcagtcttcaagtctctgtgtcgatgttacactgcttagctgtgcctgaaacctgaagggaggagggataatgaggcctgactcccacttcctatcacggcctgaaatagtttttcaggttaagtttggaatgcccttggtggagaggaggggtccattcagatggctggggggttagagttttatttttggtttccaggagacagtagttggggtgtccccagcgggaaggagaaggaggctgtctggaaggaggagaaccaagaatgcacaaaggcctggcagtgggcagtcagcgttagggaagaaggtgaaggagcagagaaaagggggaagggccacggcaggtggggacccaacccaacatgagtgacaaccagcccgccctaccaagtcatcctgaggggcccagggttccacttggctcctgtgagaaaggggtgctcactccctctaggtggatgaggccaaagtcaaatccaaggctaggatagtcatgtgactcctactcccctagggcatagcccggaacaagtgctggacacagagcctggcacagcagaggggctccactgccagaaaaaacaatggccacactctccagtgctgcccctgctgcttgtactgtcctcagagcagccaccagtgctcagggtggcatccagtccccgcctttagcccccagccccagatctgccctgggagcccagccaggggcagaaaaaaaactagttcattgagtgccagggagccctgcccaaggacatggcgtgcaagatgttccaccaactctcctcagccattaaatactgccacgacctggacatcatgcaccagaacctcaagtgttagaaccttctcctcgacaaggacttcaacatcaagctgttctacttcaggttctccaagctctgcctgcgggatgacagtggccaacagagattaagcaagaacttctgcgggttggtggcatatgcagcccccgagctgctgcagggcatcccctaccagcccatggtgtatgacatctggagcctgggcatgatcctctacatcatggtctgcagctccatgccttacgactccaacatcaggaagatgctgcgtatccagaaggagcaccgcgtggacttcccacactccaagaacctgacagacgagtgcaaggacctcatctactgcatgctgcagcccgacgtcagccagcggctgcacatccatgacaccctcagccaatgctgggtgcagcccaaggcacagggactgccctctatggtcttcaacaaggagggggaaagctcccagggaactgaactcttgtggacccctgaacctggctctgccaagaggtctgccaccaagctggagcctggggaacagacacagcccgagggacagcctgagacaaaacctgaggggttggcaatgcaaatgtccaggcagtcggacatcctaggcttccccagcaagccgtcgaccagggagaaagaggaagggccccccagcagcctccagagatgcgcacctagtgagccgtttgtggcccagtgtgccagcggcgaatgagatggagctcacgccttcaggcccaagctctgaagaagtcaaggcacaaaccagagaaggaagacggtcccggatgagccgctgttttcatcaatttcttctctctccccttgaacttcataaccgacattgctaaaggagcaataaatcactatattaatgcagatgccaaagtgaatgtctttgcctcaactgactagtcctgggctcccctccactggtttcccactcagattgtgcaatgattcctcgtttgcttgggaaaacacatcccaacgtgcccagtccagaccatgacctcaggcccaggctggggctggggcttgggctggggctgggagagacctggaggggcaggggccagagctgaaaggtgagtgaggaagccgctgcctcagaagggacgcccccaagtgcggtgctggggtcgggaaagggcagggagaggacaggaccaagaagcatgccgaggtacccctgtagaggagcgcaggctttatctgcagttgggactgagggtctgggcagacctctccagccccacaaggctgccagtgggggttgtgggaggctgcagagggcaggtggccagcctctcagccactcctgagctccctaccctgctgggcaactcgttcattgtgctctgtccatcagaggccccctgtgtccagccagcacccagctttcaacagtgccggggtcgccgcaccctgtggtcattctctagcccgggagaaataggaggctctgctggatggcccagccacactccagcctgagcatgtcccacagtcttgtgtggtcttgaccacatcttgttgtccccgtcccagcctgtcccaagggacgacacccctgcattagaagttgacactggcaagtaggatacgacaggcaaccacaaaggacaagcgctttcagaattacctctcccatggcctctaagtggatggggccaaagtcaaacccaaggctaggactgtcatgcgactcccactcccccagggcggggcctgaagcaggtgctggacacagagaatgtcagagcagaggagctccactgccagcaacatcgatgatcactgtccacagtctacctatggtcacttctctacctcgggaagaccccaacctcagtccccttggagaagtagggtctagtgagagcctggactggccctccttgcgctcttccccaagtccacctgcctcctcatgttctcacagcccccttccacgtggtttaatttcaggcctccaccccaaccctcccaccacctccgacagtgtccagagccatcccccaccagcctggctcccactgcccagtggggaggaacctaccctggcctctggggtcctcctgtggcccagtgcatcctcccctggcctctgggcaccaggcctcaccactgcgcccccatcacacacacggcccataatcatacagggaactcgcccctgcagactctgtccagctctccaggctcagctgagaggctgaggcctccataaagccttctaggggttctcagcagcctgccactgtgtactctgccaacaggcctcaaggagccaccctatttttcccaccaagaaactcatggtggagagggagcccagagtgctgggatgggggcccgggtgggacatcctgagaaatggctcttggggcctcctcctcaattatccccacggacctgcgctggtcctcagggcagtggctggcaagcaggtctgggagcctcactgtagctcagccaggtaagcccgggtgggaggggctgcaggaggagttcctgctctgagctttacagctggaaacagctcagagggagtgggccacctgtctgagatcacactgcccagggcaggagtcccaggtgacgcctccacaggtggcctcgccatgccgggcgactcctgtaggtggctcagccctggctcagaccccttcaaggattctcaaaggtgctaggaccaggacctcaacagggccctccatggcctgtccgtgctcctgccaagccacatcccttcaaaccgtcacatgtaatagctatcctcatccctctccacctggctagttcctcagacctcagccttccccagcttcccaaagtccaatccccagttccctgtcctcacagcaccatggttctgatgcgtggcacagccaccatcgcgcacacacacttggtgtgattgagcctccctcgcctctgggctccaggacggcatgggtggtctagctcatcagtgtacctcggcatccagggcagaccctcagtgcttgggggacaaataggtaaaaaggtgtctactttataaaggataggaaggttcagagagaagtggatttctcagagtgtgcaggtaccttgctcacaggactgcaaccctaggagcaacgctggaggtctccaagtcgaatccaaagctctctgtcaaacataccaggagtgccggccctgtgtgtgcatcctggatgaagcggcccgctccatgcccgggcagttctgcctctgcaatgttgacacctgcctcttctggcatgtcccccaagaaccagagagaccctcaggaggtgaagaagtagaatgcacaaaaagagggagaaggcattggtagagtctgggaagaaggcagatatgcagccagggcacggtggctcatgcctgtaatcccagcactttgggaggccgaagcaggcagatcacttgaggccaggagttcgagaccaacctgggcaacatggtgaaatcccatctctcctaaaaatacaaaaattagctgggcgttgtggtgcttgcctgtaattccagctgctcgagaggctgaggcatgagaattgcttgaacctgggaggtggaggttgcagtgagccgacatggtgccagagcatgactccatcgaaaaggaaggggaggggaggggaggggaggggaggggaggggaggaagcagatatgcagagaagtgtcccagatagggcatttgggggagcaaaggaaagggtcagggggtggtaagtgggaggtctcatgctcctgggtcctggcctgcaaattttcatagccagccccttctaggacaaaaaggagtgaagtgttggtcatttcagccgtagaggctcccaggaaaaaggaaagcatcaaactaaagctattaaccaccgatgctataaagagcttcgggtgggactctgggaggctgtcactgctggaaggcagtcactgtaggcacgtcggcccaccctgcccatctgagcctctcagcttagcatcctgactttggctgccctgtttctgcaatcctccctagtgacctccaaacacagggtgctccctgtgtactccagatggagtgggtccacacagccatgccagggccaagatgtcacatctgtctgacatgtcctgcccctcttgtcaaccctgtggagtctgctgatccccagcaccccagctccaacatcacttcctctttgaaaccttccaggactaaaccccacctgggaacaggccttcctccctctcccctaaacactgaacacacagctcatctgtcccagctgctccctgtgaatccaggatgcctgtgatggatgacaaatgaacatcagtccaacgcacctgaggagacatgtacaggatgccacatttcccaaagcacaaatccacacaccagcactgaaacaggatgttcacactgcaggtgcaaaaggcagcccgagacgtaaatgctacccaatgtcagggttccaacaggcgactgctgctcactccacacaaaggcccaaactgatgtgattcagaaccccctcctcacccaggtgcctggtctttgcagtgcatggcctgggcgctctcagccccaggattccccagcaccaaggcccatccactcacagtctagcaaacaagactaagacctgaccttctctgtctcctgctgatcctgaggcccaccctggcccagcctcttctcatttggtcaaaggcactggcccccactctcacctcaaagccaattctactctttctgtctctctctctctgccactgaccatcttaaaacacaactgggacggccctcctcctgtcttgcacctgcaggggcaggctgccgcttagagaaaaagccgagactccttcacttccctcctacttccagtcactttcagaaaaagccctctcttctcccaggctctctgctgcctgggtgccttcctgccgcctctacccaagggaggccctgccccacccctcagacatgcagccacctgccctggaccctgggcacccagctggcatgcactgcagccccgacccacccatacacaggcccttgctcgctggagcagcagcgactcacctgcccggctctctaccctgaggggcctgccgcctctgctcccaaacacagagctgctttcgtctaccaggcttggcaccactgccagcctgactggtccagggcagtccctcccaggtaccactgttcccagaaccaagccaggtccagctgcattttcttgaggcccaataacgagaagcagacaaactaggaaagaagggagtttatcactgtaactggatacagggagaaggctggagataattccagcagaccaactcaaagtgctacaattttcttactgtttatataggttggggttatgtgcctacatgcagtacagcaatcacctaagtctactggtaactaattttgttccaaggagaaggtcagaggcaaaaaaaatgcttgctaagtccgattaaaaggggcccagtgccttcaaggcctgtctactgtggtaccggagtgattatttcgattgtatctcctttacagcttggtccagagagctgccttagactatccaattgatctattcaaacagctgcctgttcccttaacttgtcttcagattttgtcgacccgagatgggtcctggcactaggaatgtaaaaccgttcctattattttggcttgctccagcaaaagagaagcccatgcaaggctcctgctgaccatgtttcatttctagctttgatgtctgggcactgatttccctagatttaactatgtgctcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacgttccattagctttcttccacttagcagcaaagacgttccttactgaccaccaaataaaccacagggtgtgtgcaagcatcaagagtgcccagtgaggagtgtttttctctgggactcagccaaccgccccacctgacacacagtggtctccggcctaggagcacaggacagatgctcaggtacaggcagaatcacagtgtggcctggccttgtgggggacaagagggcctctgccagggtccacccaccaggcccacactgtctccctctgacctggccttgtccccaatgccctggggctggccagctccagtggtccacgactccccctggcttcctgcagttcagccccctctgacctacccccactccctcacaatccctcgctcagcatcctcctcttcctctatttcctggagtcatgtgagatttctgtcctcagccctcaagttccctgccctgtcctccaggggcagccccagctgagacctccccgtgtgccctccccacccagtggctcttcaagctgctcagcagcccttgatgatggcacactggccggtcttttgtgcttcctgctgggtcacccattgctcccaaagcatgcggcccacttgctggccaagtgctccaggtggtcagcacctagacatgctcctcccccctccctccccacttcctgggggctcccttgggataacgtgcaccctttcctaggggataaagcactgaaggccccacgtcccccaccccttaagagtcccagcctgatctgtccagcaacccactgttatctgggagctcctgttggtggaagtgaccaggtgaggccagggccagcagcataagatgggcagtgcctatagcagaggggtgagtgggatagtcccaccccatgagctggaagccaggtgctgggagaaggtgatagctgagatcacctgatatgcagcccccacacagtcctataaccagcgcacctcacagccggcaagcccagagtggaggctgcagacctgggcccagaaccgcaggggaacctaagggtacaacttccaagggctccgtttctccttcatatccccccagagaagcagaaagcactgcaggatgtgagctcaactcagaacacaggttccgagtgccgcagaaagcaacgccagtcacccggtgctcccacagccgccccacctgcagcttcctcacctggggggcccctcgcttcaagccccgcagtcctgagacgtgatgcaggccccagggcaaggctagggctcgtgtggggagcaagatggagaggcaaccccccagactgtacctaggtgttctttaatgacagttcaaggggccaattaaacagcaaacagcttggcaaggccctggggtgtggtgtgggcacgagtgccttgtgccagtctggccccagcacagcccctttctccagtgactcctggtatggtcaacagcttctggcccaggcctgggccccgagaaggctggagtcctctgctgggtgtacagctgccctgcaggctctgtgaagcgtctatgagcccagcccaggcctggctctaaaagaagtccgaagctttgcgccgggcagggagctgcagcaggttgtccgtgatggaggccgggtcctgtgtgagaggggtgcgtgtggcagagccaggcgccggtgtgcttgtgggggtctgcagcccactggccggggtcttgaggtgggtggagcgtgctggggatggtgtgtagctggcccgcagggcccggtctgtgtacttgctggccgtcctgctcacaaggcgctgtagggctggcgacatggctgggctcaggcctttgggggtgaggctggggtggaggaatgggtgagagaggcagggttaggtgggctgagagctgccggcagcagggcctcccttggctcccaggaagagcctgggcagagacacagtcactctgagctgaggaggatggtactgccagcatggcagcaaatgcgggggatccctgaggtcaaacagcagcgctcaggtcaaacctgaggtcaaacagcagcaccgcccttggctgtgggggctggggtgcacccccaggcctctgagagttggagtccccacccctctccaaggggaacgatgactctctccacagggctgatgaaagctcccagcaggaccacacgcctaaagatgcctcttagggacgggtcaaagaggacgtggaggaaagagaagatggagggggcctctcatcctgtccatgtgcggccatgctctggatagaggagctgccacagtacccactgcagaaccccgcggacctgccctggactctgccgcgtgggccatgcctccacacggtcagggcaggggccgaacaggagcaggccagagccaccctcgcacttccccaccagccaggcggcccctcacctggccagattctccgtcactctccgcaaggcttcctgcttcttggcccggttcttggcagcggcctcgttggccatcttcagacccagccgctccctgcggcctggctccaggatctacaaggtagcaggtgtgtgggtagctgcgccaggcctgccacacgccaggcagcccctcacacagaaagccactgtggtgggtgccagcctctctttgttgcctacaaaacccccacaacccatcacctcccactaaaagcccctggaaagccccaaaccccacctgacctgcccaaggcgcagcactcctcacctgtcttcgtgttcctcccaaaaccatgacctctgacaatctctcaggaaaaagcagtctgttttagtgtttccctgattatcagagtgaacatctctgtctttatcggcgctctgtatttcgggcgcttccccgtgtgcctgtggcctattttgctctcaaggggctcattttccttttctgctgctgttactcagaagacccttgccaagaccttgtgtcaagtcaactgtgctacgctgtgcacatgttttttcactcatttacatttgtttcatttataacattttctgctgtatttgttattttcatttgtgatttcttcctttgcttttatgtttagaaagtccctcctaacttaagattagactacaggctgggagtggtggctcacacctggaacctcagcactttgggaggccaaggtgggaggatcacttgagctcaggcattggagaccagcctgagcaaaatgacaagacctcatttctacacacacacacacaaaattagctgggcatggtggtgtatgctgttagtcccagctacacaggaggctgaggctggaaggtcatttgagcccaggagctcaatgttacaatcagctatgattgcaccactgttctccagcctgggcaacagagtgaaaccctatctgttaaaaaaaaaaaaaaaaaaaaaaaagaggcgaggcacagtggctcacgcctgtaatcccagcactttgggaggctgaggtgggtggatcacgaggtcaggagttcgaaaccagtctggccaaggagttcgagaccagtctggccaacatggtgaaaccccatctctactaaaaatacaaaaataagccgggcgtggtggcacgcgcctgtagtcccagttacttgggaggttgaggcaggagaatcacttgaacccaaaaatcaaactaaatattcgccactattttctagtcccagttacttgggaggttgaggcaggagaatcacttgaacccaaaaatcaaactaaatattcgccactattttcttctggttgttttatggttattgtttttacatgtaaccttttcacctttccacaatgtatgctgctacacatcctgaggacccagctcccttcatttctaaatactctgctattcagtgcaatctgagttgccatctttatcgggccccaaattctgacttggatcatggtttgtttcagaatttatctgtttactgttggcctggagactcgggaagcagtggcaggcatacctcagaagcacctcagcccttgccttgcgctctcacattggacagcacggcatcctcttcattatccctctcgcacgtttgccttggttatccttgtgtcccagacaatttagaaccaaggtaaccagaacctctccccatgttttgtctggacatgggttacctgtactaagtattctggggaaaggcccgcagtggtatggggaggcctgttgtatctgacccagcccacgaagagcctcccctggtctgtgccgggcctcacacactccaccctgaccactcctacaacaccaggcttgagccgtgtaatccagcgtgtcccaatcgtgttctgtaaccaggggccttctctacaagcacacagcctcgtcctatggccctcaggcctgcagagctcctcacgtgtctgtgaccatcctgcctcattcatgaacagcacccggcctccaggatccagagggcccaagccactccctgccttggtgtctcagcccttacacccccaaatccctctgtgacaggtccacccacccacacctgccttcagcaccctggcattcagaaaagccagcactctgcccgtcagcagctgggggccgatcccagtgctcagtcctgagccacaggcactcagggctccagaggtgtccaccccggtcgcacacagttcccccatcaccacaacccaccttaaaagctgggccgggtgtcctgtccacgtagggcgtttccgacccttcaactctcaagggtgtgttctcaacctccccccaggtcatcatcggggactcgttcacacctgcagacaaagagcccaaaaccacctcaggccagaggactccccaccaccctcccctccagtcacagcttgttcacccaatgtgcatcccagctaatacgaaggcaggcagctagccctctctccttccccaggactctggaaccctggcacctccatcctccgaaagggaaatgccaagctcccagcaggcccgaggcaggctcaaggccctacagccatgtgcttagcctacaagcctctgggaggtctcccccagccacgcaggaggagacactcaggccttccagggctcccaaacctcctagaaccccaggcaaacctgtggtgccttcacatgccctggcgtgtgacacagcaccagcacccaagagcacagaggccagagtgcagagggacacccacgcatgccacaagaccacctgagtttcacctccactgaggtgctgggcctccctccctgcagtgctaggtagacttagactcataagcactgtgcacacacccccacccactgacatcacagtaaggaccaggacaggacacgtcatcccaggatgtctcaggccaggtctgcctgagagtccagcccacccacggccccaagcagcctggacacctggcctctagggccttgtacagacaggagaccaggtccctgagttacacaaggtgtggggcaggccaggtagaggccaggagtggccagggccgactgagaagcccacctcccccagggagtcccagcagtagacccacttgccagtgggcacttttctcaccaggggcaggggaaggagtggcaacaaatccaaatccacccactcgaggggactcctgggggatcagctccttgccatcggggcccaccttgccctgtttgtgctggaacaagcagagaggctggcatcagggggaccgcagcccacgctcgacagctggccggtgggcaaacacgtgggaacatgctggaaacacttcctctcctcagggcaaggctggggctctggggttggcagccttcttggagaaagagagggagggcccctgccccaaccccccaaaagaccttgagggcctgtcaaagtgggtacccaagcaaggaaagccccctcctcccatccagggaggtgccagggcctccactcgagctgcgcctatcccagcaactccagaggatgctgacgccaggcccctgcagggggcaatgctgatgacaggcaatgctgatgacaggcaatgcttatgctctagtctcttcctgccttccccacttcaaccctgtgactgccacagtcaccatcagagagtatctactcgtcttgctcccagactcagaaagcctctgctctctgccaacccagggcctgtcccaccccagccaccccctggggctgggctccctctgcggctctctggcttccctgcccggtgtgtgggcgtgcagctgccagcctgggctcactcccagcagtcccttttctctcctgcccctgccatcaagggagctggcacagatctggacctacagaacgtgtgtgaccaaggcagtgttcaatggaagcccactggggccaaggaaagactcaggatcctgccgcacagggccccagatggttccactcactgagctctgccaagctcaaagagatgggagagatcatgcctgcccccaggcagccctgtccaacctggcccatgcggccctgctgacccgcctgctcacctgggcattgagggcggctgcctgctggagctggcacctgctcagggcttggctgaaggggtccctaaggaagcgcgtgttcttatgtaccacctgccggggcttcttaaacagctgctcctcgtcagggacacctggcagacgaagcaaaggtagcagcaggtgtcagaagggcagcagcctaaggagcatgaggagctcgcttctcggccaagtcactcccagatgaacaaaagcattgagcagaacgcaggccccagtgccgctggagagggtctcactcactgctgacctcacacagacctgtccacccttagacagaccagtacccatcagaagcccaaactgcaagggggcacggccatacacacctggaaggctgctccaaacacagccagacacacacagctctacccaacacctccccatttggctgcgaggcccgccacttaccctctggatagtacatgagggaattcttggccttgtacttccaggtctccacactggcctggctgctctcgatggcctggtgctctgctgacgggagttcgagattatctttctgcctctgcaatcacatggggaaaagtgatggtcagagatgcccctgggcattgtacccatggccctggggctccccaaccaccacagagggtgcctacgcctatgtgacaccccagaccccagagacaccttctcaaactcttcctcagcctggtagagccaagcgtggcgtgcccggcttctctccttggccacctccatgatctcctggaaggaggcattgtcctcactcgtgtagcggctcaggaagacatctaggctgggcagcggctccttctcctcctcctctccagcctctcctgcttaggggttgcgggaggaggaacacagcaccctttgcagtcaggaaagaggaggacacccaggcccaggaatcatagcccccaacatgcagggctggaatcctctcccctggtcctggcttctgcccatgaaagcccacactgccaaggactccccacgggggcagaatccacccaccctgactgcccagagagccctcaggtggtaccctacagattcagggccagctctgctcatgtgctggatgccaagggaattacgtggtctgattcagactggagaaagcaatacaggtgttagagcaagagctcgtgatcacaggcaggctcctcccccaccaaagtggtgccaggcctgtgggtgccaggcctccaaatccctggggctctccctcactccctaggatttccttaccttacccactcttctcttcctggtacctgtactacaggtgggtggtcatcgcctaatcatcctgacctgagagcgagccccaattccagggatctcatatgacttagtcctctggatggggcctcacaggtgctaagccacaaccccaaacacccccccctccgaccaaccctgccaccatggaaagtggtactcccactgaggtggtgccctggtgctgcgtgtggtggtgcaaacttcggtggggccacctggagagctctgccttcaagtctagtgacagtcctgaccacctgctacacgtgaggctatgcacaaggcacagtggctacaagctcaagacccacgggatgaggacaggggtcagaaactctattcatctcagagagataagaagtgaaaccctgaccatctctgagacctgcagaagtgactgcctttctgagcctcagtttcctcacctgtaaacatgatgatggttcctaccacttaggttctgaaaaggattcctatatttactggcatgtaggtgtacaggtattgaaaatctgcaaactggctaggcatgatggctcacacttgtaatcctagcacttcgggaggccaaggtgggaggatcacttgagctcagaagtttaaaaccagcctgggcaacataatgaaacctcatctctataggaaaaaaaaaaaaaaggagaagaaaaaaatctacaaattgccctgtgatgcacaagctacatttcaacagataatcaagcttcaaggacaacaaggactgtgttaatggccgaaaaagctggattgtaaagcaaaaagtatcatgtttgcatgtttgtgcaaacacacaacacatctgtgctactccagcacagtggagtctacaaactgataagaaagagtgtctcgtttgtctatacatgcactgacattctactactgatgaaaagagggcctgacaacgcagaagtcccatggcgtgcagaacacttgcattcaacaggactcggagtgccctttcctaaaccgactcccccatcaagtcacgatgttaccatatagagctgtgtgtcccagcaaacatgctgaagatgacaactctttcatctgttccatgtgtatctgtgcaaggcccacaacaccacatgtgctgttcccaacacggagcatacagatgaaagcaaaacaaagcttctgctcttgtgcaagggatgccaattagggaaagagaccataaacagaaatgcctttaaaacgttatgtcttggccaggcgcggtggctcacacctgtaataccagcactttggggggccgaggcagacagatcacctgaggtcaggagttcaagactagccgggacaacatggcaaaacctcgtctctactacaaaatacaaaaattagccaggagtggtggcaggcgcctgtaatcccagctatttgggaggctaaggcagggagaattgcttgaacctgggaggtggaggttgcagtgagccgggatcacaccattttactccagcctgggtgacagagcgagactctgtgtcaaaaaattaaaaataaaatgaaattaaataaaataaaatgtcttgtgatgaaaaaccaaagccaggctggaagccacagagcaccagtggtgttgtgacttcacactggcaggtcaagaaaagtttctctgaacaggtaacacctatgcagagatctacaggaagaaacacagtgagccatgcagttatctgggaagtgaccaacatgaaggaaacaaatggagaggccctgaggcatcttcaggatagtaacaaaaggggccttccaacatccatgaagcccacagggcagggctggaacacagcagaaaagccagcaagagctggtgagagtcccatttcacagaggcgagccatgtgtgggagctggacccagatgttctaccacctagaccaatgtcctttgacttcacaggctgctatttacgcaagacccctcaggaacaagatgtggcctgcagccctctggaccaccccctcagggcctcacaggctaagattcccaggcaatcctgaccatgtgacttaaagagggcaccctcactcaccatcctccaggcctcggccgcggggcctgggcttgttgcccaccactccagtgcctgcatgcacctcaggggtttcaaatgtggctggagtcacatctaggggaagagagggggataagaattagagtgagcctgaagcgacagttcagcaggctttcccctctccgccacccacagggtcctcatacagggtggcgggggctcccgggacatcttgcccaaggcagagccaaacttgatggcaatctggcgcatccgttccaagtctccattctcctcggcttccaggtactccttctgtgcctggagcttctccacatcaggaaagaaatccctttggatgaccgtctggaggccctgcaaggagagatcagaatgaaagtcagaggccaggcgcggtggctcacacctgtaatcccaacactttgggaggccaagggaggtggatcatgaggtcagaagttcaagaccagcctggccaacatggtgaaacccagtctctactagaaatacaaaaattagccgggcgtggtggcaggcacctgtaattccagctacgtgggaggctgaagcagaagaatcgcttaaactcgggaggcggaggttgcagtgagccaagatcacacccctgcactccagcctgggcgacagagcgagaccgtctcaaaaaaaaaaaaaaaaaagaaaaaagaaagtcggagctgcagtctgggtgctcctgcctcacaggtccactgctgtacatgctaaggaacttgctgaacctccttcaaattctacttccccaatgactggggctggattgagggagcttgagggcactttctagtggggttgagcatcccatatggtagccatgctgcaacctctaacattactaaacactcttctgaagtccgtgaaacccttctctctcgcccttgctaactggtcattctcattctccattgctggctccccacaagccagaccaatgtgggtgttgtcactttcattccacacatgactttctatttccaatctaaacctttctcctggcggggcatggtagctcacgcctgtaatcccagcactttgagaggccaaggcgggcggatcacctgaggtcaggagttcgagaccagcctggccaacatggtgaaaccccaccactactaaaaatacaaaaattagccgggcgtggtggcgggcacctgtagtcacagctactcggcaggctgaggcaggagaatggcttgaacccaggaggcagaggttggttacagtaagccgagatcgcgccactgcactccagcctggacgacgagcgagactccgtctcaaaaaataaaataaaaataaacctttttcctgagtaacttcagccagtcactaccacaagttgagattcccaagtctgcacctccagccagaccttgctcccgagctgcatatctgggcacccaaccgtccgttaaagccatccatctacatatcccaaaaggtgtcccgaattaaacaggtctaaaaccaaactgacttccgccaatccccgtttcagctcctccttctgtgtgcgtgtggtggggcgacgcaggtccactcactcgagatgctgtcacaactgcggtctctttccaggaaccccagcattcacacttgctgccaccgctctttagaaagccctctttgccaccatccttccagtttgtcaaactcctactcacactttaacagaaaatcttctttccctgacccccgtcccatacaaagagagccgctctctcttttccctgacaacactactacagcctcttccaccacagacgtcttcctctgccctgtttacttgactcgtgggaccgtccacacccggctcctccacttccacgaggagacggagtgtcaacacccgagagagggaacctgagaggagcttgaagcagaggatgggcccagaagtcgccggcgtccgcaccgaggtcgtacctcgatatactcttcctcgtccaggacccgctgcttgctcgtcgcagccccagcctctcccgcctcgcgcttcctcgggggcctggacgcggcgggaagcaacaaggacgacgctgatgcgcccggcgtctccatcgctatcccaggaaaaagctcgggcccagcaggcgcgtcacagggtggagggggcgggactgcaccatttgcgcaggcgcctccaatagttggccaatggaaaagctgtggctctagaaagccagcccgcgctccgttctgacgtcactataaatgctagactttattggaaatgtagtccttgtcctgccccgcgctattcatgcttgtcaatgctgtgaacacgagggggtgctgtggaggtggcggggaggatgctatagggcgtgttcttcacgcgagaaattctggctttgcagcgtccaaaggccttagaattctaatttcccacaaataagaactatgtatgcttcgagattattctacaaaaatacaaaccaggaaatttacttatataggagtttcaagctttatgcaagaaaagggccttaaaacaattttttttttgagacggagtttcggtcttgttgcccaggctggagtgcaatggcatgatctcggctcaccggagttcccgggttcaagggattctcctgcctcagcctcccgagtagctgggattacaggcatgggccaccacgcccggctaattttgcatttttagtagagacagggtttctctatgttggtcaggctggtctctggattacaggcgtgagccaccgcacccggccaaaacaatcttttttttttttttatagttatctaacaaaaggtgaaagaacaagacagtggttcgattaagaaatgtctaaagattattctgtaatcccagaactttgagaggccaagacaggcggatcacctgaggtcaggagttctagaccagcctggccaacaagatgaaaccccatctctactaaaaacacacaaaaaaattagctgggcatggtggtggacgcctgtaatcccagctactcggaaggctgaggctggagaattgcttgaacccaggaggcggaggttgcagtgagctgagattgcaccattgcactccagcctgggtaacaagagcaaaactctgtcaaaaaaaaaaaaaagattattgggcccccaaatgccagagtgggcttcccagaagagggatcattctcattcaagaccaggcacggtggctcacgcctgtaacctcagcactttgggagacccaggcaggtggatcacttgaagtcaggagattgagaccagcctggccaacatggtgaaaccccaactctactaaaaaaaaaaaaaaatacaaagtggtggtaggtgcctgtagtcccagctacttgggaggctgaggcaggaaaatcactcaaacccaggaggtggaaactgcagtgagcagagattgtgccactgcactacagcctgggtgacagagtgaaactctgtcaagaaaaaaaaaaattaatattcaagtgaaccagaaaattgcctcggcatttttaaggaatttcttcccaaacgaaagatgtgaattgtgttggacaaataaattccgccctggaacaatttaatacaattttgcttttgcaacatacagggataccttcattcactgaagtgcagcgtgctgctgctgcccttgtagaagtgacagtgcaatggggaagacagagacacttgttagatcatcacacaaacaggtgtaaaattgcagctgtgtccgtgcaagaaaagagtttgtacttggggaatcttgacctagttcgggaggtcagagaagcttccccaggcagaaagtgattgcagattcaaaagacgaacaaaccggcaacagtcaggtggaaagagcatgtgcaaaggcctagtggtgggagggagcaaggcaagttctaaagaagtcctttggaaatgcagagtgcagtgaggtgtgagatgatgccagagaggcagggccaggctgcacagggccttgtagggtatggtgaggtggtttgtcttcattctgaattgaaggggcaggccaggcacagtggctcatgcctataatcccagcactttggaaggcctaggccggcggatagtttgaggtcagaagtttgagaccagcctggccaacatggcaagacctcatctctacaaaaaacttttcaagttagtcgggtgtggtggtgcccacctgtggtcctagctactcagaaggctgatgggggaggatcgcttgagcccaggagctggaggctatagtgagccatgattgcaccactacactccagcttgggtgatggagcgagaccttgtctcaaaccaaccgacaaacaaaaaagcagagccagtgtggtgcaggtggacaagattagagacagttgcagtggtcaaggtgagaggtgacggtggcttacatcagactggtgcagttagagctggagagattctgggatttattgatttattgataaacagtaaaactgacttcctgtcagcctgggtatagtggatgatcaggagagggaggggtccagggaccagtttcgggtgggcggctagctctctggctcatgtgcctggtttgcacagaagagctcactgtggacaaggtgaccttaaggagtctgtgggcttcaaggggacagctggagataaatacctggctcaggggaagtgcctggcttgagatgtaaatgtggcagaaagatgggaattggagtctgagggtaaaagataaaccgggaagagggtgaagatgagaagcgagcgcctgggtgtgagcgtgaaggatgcctatgttaatagcctgctgtggggggtcagcctgccaaggagcagctagagctcaagaagcaaattcaggagagcaacacagccactgagccctggaaggtggcgctccacaagctctgatcggggctcccaaaacaatgacagatggccattcaaccaaggaactcaaggggcctggagcctgtgagatgcgagtgtccccagctgcaagggagctgactgggacacgggcatgtccacaggtagtctgttcagtccccaagggcaagaccagggttcagggagaagggctttgtgtgcatgctaggggtggaggcggggatgctagggacacccagcagtgtcagggcagttctgactggggacaccatgcttgcttggtgttatccaagctggccagccttggggtgtctggggagctgcagccctggcttctgcagtcctgcttttagagatggacttcatctcttgcaggtagaatggccccattccctgcagggcctgtaaggagacagaacgaggtgctcaagccagctgggggtggggatgtgagatgctttggacccactgtagggcctacttggggaatctaaggcttctttccactgtgccttttgccatgggccaggataaagaaggggagggcaggcatcttcccaggcagcaggggcggggtctccccagtccaacctcctcttgccctaccctaggatggcacagattgctgtgagggagtccgagcccacagcatgaaaaccccaggaggaagcaggggaccctcacccatgggcaggttcacagtagcctagaggccagggctggaccccaggggtccaaggccaccatccgtggagcagtcccctctgctggggagcaccctggtgcagagactgaggatcgctgagctgtgctcctctcaaagacagctgtaccctaaataccccctcgctgggaaggaagaagaagggacagctccttgttgggtgtgggagtggagccaaggtggacttgagactctgggcggcttctgtggtatttgaagttgctagtttctcagtatcagcgcgaggctcgaaggtgaagggactgtggaggggctcctggaatcgctcctgcgaccttcttattctacaggtccagataccaagacccagcccagggcctgggaagcctgcaacgccaggactgcacagacacgaaccccatcccctctcccgctgggggaggacgagccaggtcaagttaggtcaatgtccacattgagaagagggtggccagcatgtcccagggtgcggagagacgctccactgcgtaggattctgggtcccgtgttgatacggggtggttcccctcctgcggtggagttagtgtctctcggggggtagggagctgaggaaactgctctatgccccagcccacccccaagggactcgccactcccactgccgtggaacaccaagcaccgggggcccgtccccagcgccacggcagcacgagctgcaggaggcaagggctgtggagacgggtggaggcggccggtgtactctcccagctccttttcgggtagacctgtcttctctcagcgccaactccaaagatcccaaaaagggtggccgagcccaggggcagctcctagagtcatcagcagctccccttcggggacttcttgacgccgggcaggagcctcgcggaagccgacgcgcgcttctggtgtcgccatttggcccggcggttcttgaaccagacctggggatggggggaatgctcagccctagccccaggtcctgcgtcccaccggctcccgagggtcccacagggaccgagaggggagcttcgcaacagggatgtgggcggacggcgctgtagagccgacacccgggccgcggctgcgcgccacctgcccttattcgctgcggacagactcggtgggtctggacgcgagatgggaacccccttagtacccgccccagcctccagctggcggcgaccaggacgccccttcttgggttgcgggctcttctgaatttcccaaattctggacgtgaacgcgggcctctttcgtcaccagaggaaagtgtaaaacaaaagaaaagaaaagtagccctccggttcctttcccgcggcacctccctgctctcacccgctcctcatacccccggacgcccagcgccgtccagggacctcctccctccggcgcgccagggcggggcttgggccgaggccgtctttgcaaagggcgcccgcccgccaggaccccagtccagtgtagccgcggcccgcgcgctccggggaaaggctgggcggggcactcacctccacgcgctcctcgcgaaggcggatgcggccggccaggcgctcgcgcgtactcacgtcaggatactggttctgcacgaaaagcgcctcgagcgcctgcagctgctcttcgctgaagatggtgcggtggcgcctcgtgcgccgctgcgaacccgggccgaccgcgcccgggagcgccccggaacctccggctggcgcacccagagacaagggcaccgccggtcccagcctcagcggccacgccagacgagcgcctgcggagcgagggcgcggtgaggcgcggggctggggccaagctcggcacccactgcgccgcgccccgggctccgccgggccccgcgccccgctccgcgcccactcacccagcccggcggccgcctctgggggcccgcagggcgccgcgcgggggccgcagcagcagcagcaggcgcagggcgcagcctcgggcgccccgggctcctctggcttcgcggggctctggcgaccggcgggctgcggtgggcaggcggcccgggccgggaggctccgctcgggcaggctggagaggatgtgctcgatggagaaggggcagggccgcccggcaccccggcggctcgccgcgcccccagccgctgccgccatgcccggcccggccggggcgccgccgccgcgggaatatatacgtcggggagggagcgcgcagtaatccccgggccgggcgtccagtccacgcgggttaatcccgcagcgccggccgcgaacgcgctaatcctcgactgcggcggccctgcctccgcgcgcgggggccgggggcgctgcagagagggccccctgtgccccccaccccgccccgcgtcctcctgccccacccgcgcccgccgctcaagctggcagggcgacctgcggggaaggggcggagggccgcctcgccgccgcccgcggggcctggcagccgctcggagggcgccccgaccctggcagctccccagagcgcggcggtgcctcccggcccagcctctggtggctccccctcgttcggctgggcctaattcctcgtcccctctggggccctactgcggcggctcagcacgcctgcagaagctcggcctagccgcccacccgaaactcctggaccgcagcctccatggggcccagcaccaccggcaaccgcacgatcccgccgcgctcgggtcccgaacctgcccgccacctcggagccagggtctcatggccctggagggcgtgagagcgcggcaggaagcctgggctgccgggtgcccccagttctccgtctcctcacctgtgtcaaggagacctccccgccccttccgaggcccctcctcggtgcttcagagccgcctgtcctccagctttcccactggtcccagaatccccgcgaaaacatccaacactgcacctcgcccttccccgcactgtcactgccccccagaagctgtgggctccccctcctcgctctccgcccaggccagtcctctggccacaccgtcctcggtcccttctgccacagcgcaggtgacccgcacttggctacattgtttcaccctcagtgaagcggctcctggcagcgggaccgtcacttcagcttaagaccctttcctcttgacctttgaaaatacagtatgggactcatagcacagagaaacagacggcctggctcatactccgttgtcaatttctggccgtgtgacctccataggcgtcttcagcctctgggcttggctttcccaatctgtaaagtgtagtgactaggtgtgagacggttagaacctggccgcctccccagggcaatgcgtattcctgcgctcctcccgccgccagcccctctgcaagactctgccatccccactctgctatcagtgaaagtgctgtggacatcactgtgaccgaacctgctgatttaatttctgtcacaagagctcccacataggtttcccaggggtagtctggaggctcagtgatgagctgccacctccatgagtggctctgtcaacccctcctccacccacctcttggtggtagaatggctgccacagccccacacttttcatctcctcccatggccctttggatggccatggatccctcctccctcagcagacctccctcacagaactgcatctggaccatcctccaaaatcagagtgctgctatgatgggggaggcagggtcattggtcaggagagccagcccaacatttgctgagccctcttcctcctagccctggccattccttcatcctttcccattctcaccctcaatacctattccagccttggagctccagacaccatctttgtgacagtgactcacaagtgcacctccagcctggcctctctctctgctccacgctcttgtttctggagcctgctccacatctccatctccactaccaataaagttctcccagtcaccatgccagaaaggaactcaaggtcttctcaaaatccctttcttaccctatgttctccacttttacaaatgggccactgcccacctgtccatctctagtgctcattctcttctacctatttgcctctgcgtgtgccctgcctctttaccagtccaccttggtaaatggcccactgtggcactttttcaaaaagtttattttctattttgcattattttttgagacagggtcttgctctgtcacccaggctggagtgcagtggtgtgatcatggctcactgcagccttggcatcctgagctcaagtgatcctcctgcctcagcctcccaagtagctgggactacaggtgcaccaccatgctcagctaatgtttctgttttgggggggttttgccacgttgcctaggctggtctcaaactgccgagctcaagcaatccgcctgccttagcctcccaaagtgttgggattacaggcatgagccaccgtgcctgcctggcctgcccccctcccttttttttttttttttttttttttgagacggagtctcgctctgtcgtccaggctggagtgcagtggcatgatctcagctcactgcaagctccacctcccgggttcacgccattctcctgcctcagcctcccgagtagctgggactacaggcgcctgccaccatgcccagctattttttttttttgtatttttattagagacggggtttcaccatgttagccaggatggtctcgatctcctgaccttgtgatctgcccgcctcggcctcccaaagtgctgggattacacgcccggccttttttgtttgtttttttacttttgagacagggtctcgctctttcacccaggctggagtgcagtgggtgaccatagctcactgcagcctctgaacacctgggcttaagaggttctcccacctcggcctcccaagtagttgggagcacaggcacacgccaccatgcctggctaatttaaaaaaaattatagatagggtctcactatgttgcccaggctggtctagaacttctgacctcaagcaatccacctgcctcagcctcccaaagctctgaggttacaggtgtgagccaccgtgcctggccactctggcgcctctgaaacatgctggcaggttctctgatgctgctccctttgggagtttaattgggtttcttcctgaaacatgggctggccttcacgacttgcttgtaatccatagaatgcagcagaactgacatcgtgtggtttctgaggccaagtcacacacagagtcacacagatcagatcagcaacccaactccttctctctctctcacacatcttgggatgcttgatctttacacccagccaccatgctgtgaggggcacaggcagcctcgggagaggataggcgtgttcctgccagcagcaccagctgaaggacccatccaccccctgcacgggtcacctacaagtgagtgaggaagccttccagatggctctggccccggccaccattggactgcaaccacaggagacaccaaaactgagaatcccctccctgagcccagtcaagccccatgactatgaaatataataaaatagatgatgctgggtgtttttactgcaccaagtttgatgtggtttgttatataactatagataagcagaacgggatctggtactggaagtggggtgggtgctgctgatacaaaacctaaatcatgtgacattggctttgggatggggcagtgtccaggagctgggaggaccttgcagaggctgacagtggggacttagaggaaagtgaagaaattgttactggaagatggaggaaagaagaccattgttatgcagtggcaggaagtttagcaacattgtcacctgtagccaaataggaaatagaagctagatagtattcccaagaataaaatgatctaaggacatacccagagagaaagttcaaggtgctacttggcttcttctagctaccaataataaaaagaaagaagatatgattcaaaaagcaagatttagggccgggcatggaggcttactcctgttatcccaatgctttgggaagctgaggtgggagaatcacttgaggccaggagttcaagaccagcctgggcaacatagcaagaccctcatctctataaagaaaagttttttctttaagatggagtcttgctctgttgcccaggctggagtgcagtggtgtaatctctgctcactgcaacctccgcctcctgggttcaagcaattttcgtgcctcagcctcccgagtagctgggattacaggtgtgtgccaccatgcccaactaatttttttgtatttttagtagagacggagtttctccctgttggccaggctggtcttgaactcgtgacctcaggtgatccgaccgcctcagcctcccaaagtgctgggattacaggcgtgagccaccttgactcatcaccctggagcttcaggtacttctcttgatgtcctcatctcctaacatccttcctcttcctccccctcccctcccccttcccctccccctcccctccccctcacctccccctcaccctccccctccccttcccctccccctcctcctccttcttcttctccttcttcttttcttttcttttcttttctttttttttttattttccaagacagagtctcactctgtcacccaggctggagtgcagcagtgtgatcttggctcactgcagcctgcctctgccttccaggttcaagcaattcttgtgcctcagccacctgagtagctggattccaggcatgcactgacatacccggctaattttttgtatttttaatagagatggggtttcaccatgttgcccagcctggtctcgaactcctgacctcaggtgatctgcccatctcagcctcccaaagtgctgggattacaggagtgagctactgcaccaggccctcatctcttaacttctaatcttgctctgtccaggtccctgaaccaaccagctcaactatttgctacagctggtgggtcttgcaggttctgcctttgcagagtggatggcacagtgctcacagaaactctgccgtttgggagtctttgccctcatgctccactgccgttcagggctgcctgagtgagctgtggggcagatgtcataagtgaggccacatgggatggcagtcacctgctttcacagcttacgtgtgtcctctggacttgctgagagctgatcctcgtaatgccacttctgttgtgtggatggttggtaccttgagacctggtggcttggccaagcacagtggctcacgcctgtaatcccagcactttgggaggccgaggcaggaggattgcttgagctcaggagttggagaccagcctgggcaacatagcaagaccttgtctctacaataaataaaaaaattagctgggcgtggtggcatgtgcttggggtcccagctactcagaaggctaaagcgagaggatcgcctgaaagatcgcctgaacgagttcgaggctgcagtgagccgagatcaaaccactgcacttcagcctgagtaacagaacaagaccctgtctcaaaaaataaaataaataaagcctggcatggtggctcatgcctgtaatcccagcactctgggaggacaaggtgggtggattacctgaggtcaggagtaccagaccagcctggccaacatggtgaaaccccgtctctactaaaaatacaaaaattagctgggcgtggtggcaggcatctataatccgagctactcgggaggctgaggctggagaatcgctttaacccaggaggctaagttgcagtgagccaagatcacaccagtgcactccagcctaggtaacagagcgagactgtgtctcaaaataaaataaaataataaaataaaataaataaaagacccagtgggtgtctctgacaatacccagctctaatgagccttctggtcactcagtagcccatcgtcagatgcccagttcctgccagggcccagaaacgtggaaggagctgttttgttttgttttgttttttgagatggagtctcgctctgtctcccaggctggagtgcagtggcgcaatctcagctcactgcaacctccgcgtcccaggttcaagtgattctcctgcctcagcttcccgagtagctgggactacagacacctgccaccacgcccggctattttgtgaatggtatgtggcatggccttgctccagaaccctaggagtgggcactgccacccttccactgcagcctgctgaaggcgccacatgaaacctttctctgccaagcgttggccatggctctgtcaggtcacagggtcaggctcagggctgctggtaccacagcctggacctgcagcaaatcccatactgccctaggctctactaaaagctggcatcctccatatcacccacaaatttcttgggcagtattcccaagttttttccgcctccaaatcgcaaagaagcctcaccctgttgtgttctttcatagtggtgagaggagctgggcgctcgcccttcgccttggaggagttgctctggcatcccaggccgctgggctcccagaggctgcttttttttttgtctcttcttcattaccggtttgtgagagttctttgtatatttaagatactagtcccttatcagatatatgatttgcaaatattttctctcattctgtgggcagtttttactttttccttttctttcttttttttttttccagagacagagtctcgctctgtcgcccaggctggagtgcagtggcgcgatctcggctcactgcaagctccgcctcccaggttcacgccatactcctgcctcagcctccccagttgctgggactacaggtgcccgccaccatgcccggctaacttttgtgtttttagtagggatgaggttttgccatgttggccaggctggtctgaccttaggtgatccgcccacctcggcctcccaaagtgctgggattataggagtgagccactgcacccagcctttacctttttttttttgaaacaaggtctcactctgtcgcccaggctggagtgcagtggcatgatcatagctcactgcagccttgacctccttggctcaagccatctttccatctcagcctcttgagtagctgggaatacagccaaatgccaccatgcctggctaattgtaaaaaatatatatatacgtatacacacacacacacacacacacatatatatatttgtagagacaaggtcttgctggcctggcacagtggctcatgcctgtaatcccagcactttgtgaagctgagatgggcggatcacctgaggtcaggagttcgagagcagccaagccaacatggtgaaaccccgtttctactaaaaatacaaaaattagctgggcgtggtggcgtaggcctgtgtcccagctactagggagtcaaaaaaaaaattgagacaaggtctggctatgttgcccaggctggtctcgaactcctggggtcaagcagtccttccacttcagccacccacagtgctgagattacaggtgtgagccattgcgcctgcccgttttttgcctttttatttttagagacaaggtctcactatattgcccagactggtctcaatctcctgggctcaagtgatcctccagccacaggctcccgaatagctggaagtccagacgctcaccagcatgcctggcttcagctggcattttaataggagttatattgaatctgtagattagttttcggagcaatgccatctcaacaatatttaactcttccaagccatgaacattagatgtcttccatttatttagtgctttgatctctttcaacaatgttttgtagttttcagagtttaagttttcattttgtttacatttgttccctaatattttgttcttttttttttttttttttttttttgacagagtctcactctgttaccaggctggagtgcagtggtgtgatcttggcccactgcaatctccgcctcctgggtttgattcccctgcctcagcctcccgaatagctggcactgtaggcgtgcaccaccacacccagctaatttttttttttttttttgtattttagtagagatggggtttcaccatgttggccaagatggtcttgatctcctgacctcgtgatccgccctccttggcctcccaaagtgctgggcttacaggcgtgagccaccgtgcccggccaatactgatgcattttatttctttttcctacctaattgtagagctttcttttcttttttctttttctttttcttttttttttgagacagagtctcactctgttgcccagctggagtgcagtggcatgatcttggcctactgcaacctctgcctcctaggttcaagtgattctcctgcctcagcctcctgggtagctgggattacaggcacgcaccaccacgcctggctaatttttgtatatttttagtagagacggggtttcgctatgttggccaagcttgtcttgaactcgtgatctcaggtgatccacctgcctcgttctcccaaaatgctaggatcataggcgtgagccactgtgcccagcttagagctttcaatacaatgttgaattgaagtggcgagagtgtacatccttgtgttgttcctgatcttagaggaaaatgattcggtcttcaccattgagtgtgatggtagctgaggatttttcataggtgccctttatcaagttgtggaagtgtccttctttttttttttgagacaaagtctcactctgtcgcccaggctggagtgtagtgacgcaatctcctctcactgcaaccttgcaatctccgcctcccgggttcaagcagttctcctgcctcagcatcccgagtagctgggattgcaggtgcgtgccatcaagcccggctaatttttgtattttcagtagagatgggttttcaccatgttagtcaggctggtcttgaactcctgacctcatgatcttcccgcctcggcttcccaaagtgctaggattataggcgtgagccaccgcgcccagcgtgtccttctagttttgggattaaacaacatgatccactggtttttgcaggagccagataatgtattaaactgggatttgctaaagaccacattgcaacctcctttcaatctttatttatttattttttgagacagggtcttgatctgtcactcaggctggagtgcagtggtgtgatcaacactcactgcaacctcaccatcctgggccctggtgattctcttgcctcagcctcctgggtagctggcactgcaggcatgcaccatcgtgccgggctaaattttgtgtttttttatagagacagggtctcactatgttgcctaggctggtctcaaactactaggctcaagcgagccccctgcctcagcctcccaaagtgctgggattacaaggcatgaccagccactcccggccatcctttcaattttcaactgagacctctaagctctgctatccttcctgggacgcagcactgtatttttttcttttgagacggagtcttgctctgtcgcccaggctggagtgcagtggcgcaatctcggctcactgcaagctccgcctcctgggttcacgccattctcctgcctcagcctcctgagtagctgggactacaggcgcccgccaccacacccagctgatttttttgtatttttaatagagacgaggtttcaccatgttagccaggatggtctcgatctcctgacctcgtgatctgcccgcctcagcctcccaaagtgctaggattacaggcatgagccaccgcgcccggccagcactgttttttttatcttggtaggggcagttcaggaactttcatgtagcctttattgcaaaacaggtctcacttttgagaactgaaagtaaaatcctaagcactcccaccaactgaaaagatcccccttgaccaaaggaccccagagaaaccttaaaaactgagttaacagccatgacaggacagaaggtcagacatgcctcgctgtaccctgtcccttttgtggtttaggcacaactgaccaacattaatgttaaaatagagatcataagactgacagaagagactctggcaaaacgataccaaattataaacaggaccaaaggccatgctaggcaaggattaagtcatgcacccctatacttaaagaagaaactatattctgtcacaggtggtttttttttcctctaacagttaaacaagcactagcctcaagataaacaatattaaaacaattacaactcaaccactgccagacactcactgaccctcctgttgtacaagccacaactacagctttgataggacatgagactggatttagtaactttcttctgataaaaagaccatccaccctagactggttctggctggttacagaggctgcacacttgcgtgccttcacgtccgtccctacttcaccttctgacgtgtagggcctaattgtaatgcatttaaatgtgaagtctccgccccaaagtaaacatggctgcatgggacatgcgtatttgcttctcacatatgcacatgttcccccttcatgaatattcacagctcctcctagatcctgttaaatatgtatacttggctggcctggtgcggtggctcacgcctgtaatcccagcactttgggaggctgaggcaggtggatcatgaggtcaggagatcaagaccatcctggctaacacggtgaaaccctatctctactaaaaatacaaaaaaattagctgggcgtggtggcgggcacctgtagtcccagctactcaggagaccgaggcaggagaatggtgtgaatctgggaggtggagcttgcattgagccaagatcgtgccactggactgcagcctgggagacaaagtgagactccatctcaaaaaatatatatatacacacacacacacacacacacacacatatatatacatatatatatacgtacacatatatatacacatatatatacgtacacatatatatacacacatatatatatacacatatatacacacatatatacacatatatatacacatatatatacacatatatatacacatatatacacatatatatacacatatatacacatatatatacacatatatatatatgtatacttggctctcctattcagcataaattcctgtttcaccgctctcatcctaaacatgcctgtcttttgatctctgcgagaggctacacttcccagcctggccgccttgcaggctataaccctttataagaaataaagttggcagagcacagggctcatgcctgtaaccccatagtcccagcactttggaaggctgaggtgggaggatcacttgaggccaggagttggagaccagtctgggcaacatagtgagaccccatctctacaaaaaataaaaaaattagcaggtatggtagcgtgcacctgtggcctcagctacttgggaagctgagaggggaggatctcttgagccccagaatttgagactgcagtgagctatgattgtgccactgctctgcagcctgggtgacagagtgagactgtctctagagaaaagaaaataaataaagtctcctttctaaatttataaattgtgtgatttttcagttggcactctacaggttagaaatcactgtgaaagttctgccaaatactaaatatgtctattccaattatgcattcagaaactgcagaaataacctgtgagtagctcatgaattgctgggcccactgtgggatggaattgggccaggactttgcgtactgcccggctgtctgtgctcctgctctagcagggaggccatgagggcactttgggtcccaggaatcagtgctgacttggagccagtatccaacagcactaaaaagatctgggttttccctttccccagcgcacagctacctgagtaagcggaaacaggccccttcgtgaaaggatgaggggaatcactactagaagtacctttcatggtgttcctggctccttcctcatgggaaggagacttcagcagaggaggtctgggcctgagaactggctggacactgggcgacactgagacatttcagtgggcaggtgacctgacctcagccttttgcccttctattatttttacttatgtttttaaatgtaaaataaagacagcatagcatttaccattttaacctttttgtttgtttgtttgtttttggtagaggggatcttgctctgtcacccaggctggagtacagtggtgcagtcatggctcactgcagcctcgatctcctgggctcaagcgattctcccacctcagcctctggttgctggaaccataggcatccaccatgtgtacctaatttttgtatatttgtagagactgggtctcacttatttgcccagattcattttaaccttttctacgtgtgcaatacaagtgtgcattaaggatatccacaaggctgtgtaaccctctccgcgaccattcccagagctttcctaatcagaaaactgtaaccattgcacagtaattgcccttccctgaactcccagcccccggcgagcggggctcatggctgaataacactgcactgcatgtgcagactacattttgtttatccacttatccctccagggtccttgggttgtttccaccctctggctgctgtgaatagcgctgctgtgaacatgggtgtaatgcgcttgcttcagttcctgcattcagcccttctgggtatatactgaggagaggaattgctggggcgcatggtaattctatgtttagggttttgaggatccactgaacttttccacagctgcatcttacattcccaccaggttcccataaaagttctactttatccacgtcctcaacaacatttgttattttctggttttaaaatgtatagacatcctagtggggatgaagtatttttctcattctgacttttttttttttttttttttttgagatggagtcttgctctgtcacccaggctggagtgaaagtggtgcgatcttggctcatcgcaacctccatctcctggttcaagtgattctcgtgcctcagcctcctgagtagctgggattacaggcgcccgccactacactcagcaaatttttgtatttttaatagagatgggtttcgctaggttggccaggctggtctcgaactcctggcctcaagtgattggccagccttggcctcccaaagtactgggatcacaggtgtgagctattgtgcccagcctctttgcttatttatttatttatttatttatttttatttatttttttgagactgagtttcgctcttggcccccaggctagagtgcagtggcacaatctcagctcactgcaacctccgcctcctgggttcaagcaattctcctgcctcagcctcccgagtagctgggattacaggtggctgccaccacacccagctaattttgtatttttagtggagacagggtttcactacgttggccaggctgatcgtgaactcctgacctcaggtgatctgcccaccttggcctcccaaagtgctgggattacagatatgagccaccgtgctcgtcctctttgctcatttttaatgtttttttcttttttcttcttcttcttttttttttttgagagagtctcgctctgtggcctaggctggagtgcagtggctattcacggctcactgcagccttgaaatcctaggctcaggtgattgcgtgagccaccatgcccagccagttgtttgttgttgttgttgtgttgacttacattattttttccaatatttcatcatgaaaattttgatgaaattttcatcaaaatattcagataatttgaagggatattcactgtctagattattcaattattagtattttgctatagttgatttatcactatgtatgcattcgtcttttatttttacaaatggggtcttggtatgttgcccaggcttgtcttgaactcctggactcaagtgatcttcccgcctcagcctcccaaattgctgagattataggcgggagccacagcagcaggccaggattgttttttattaattttccagtggcctgccaatggtatatataaatccagtccatgtttgtgtagtcatctggtaactgttttagcatcccagcacacagtcaagaaaaataaactttaaaaataactaaaataactaaataactaaatggcccaggcacggtggcttacgcttgtaatcccagaactttgggaggccaaggcgggtggattgcctgaggtcaggagttggagaccatcctggccaacatagtgaaaccctgtctctactaaaaatacaaaaaattaaccaggcatggtggcgggtgcctgtaatcccagctacttgggaggctgaggcaggagagtcacttgaacccgggaggaggaggttgcaatgagccgagattgcgccattgcactccagcttgggtaacaagagtgaaactctgtctcaaataaataaataaaataactaaatggaaattctagaactgaaaaatgcaacatgagaaataaaaaattccctaaataggcttaacagcagaagaaagataacagtataacagaagagtcagtttgagactagccggataatagaaattatccaatctggggtgggatggtggctcgcacttgtaatctcagcactttgggaagccaaggcaagcaggtcacttgagctcaggagttagagaccagcctgggcaacatggcaaaaccccacttgaatttctacgaaaaatacaaaagttagccgggcatggtggcacatgcctgtagtgccagatactcggaggtggaggcgggaggattgcttgagcccaggaggttgaggatacagtgagccaagatcacaccactgcactccaacctgggtgacagagcgagactccatcttaaaaaaaaaaaaaatcctggcactttgggaggctgaggagggcagatcgcttgagcccaggagttcaagaccagcctgggcaacatagagagacccccatctctataaaaaatacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaacaaaagcaagtaaaagaagattttttttgtatagagtcaataatatataaaagggcaaaaataggccgggtgcggtggctcacgctgtaatcccagcactttgggaggccaaggtgggcaaatcacgaggtcaggagatcgagaccatcctggctaacacggtgaaaccccgtctctactaaaaaatacaaaaaattagctgggcctggtggcggccacctgtagtcccagctacttgggaggctgaggcaggagaatggcgtgaacctgggaggcggagctggcagtaagccgagatcacgccactgcactccagcctgggcgacagagcaagactccatctcagaaaaaaaaaaaaaaaaaaaaaaggcaaaaatagagaaaataatgaagccaaagataaacaaaattaataaactaaactgaatcagaaaaaaggaacactaattactaatatcaggactgagggaagggatgtaactatagattctgcagaatttaaaagaataataagggaatataatgaacaactttattaataatctatagttaacctgcagttaatatcatactttctggcaaaacgttggttattttctccctaaaattaagagtaaagtaaggatatccatgacacttctattcaacgttgtcctggaggttttagtcagtgcaataaagcaagaaaaatatagaaaaggtataaagggcttggcatggtggctcatgcctataatcccagcattttgggaggccgaggctggaggatcacttgaggccaggagtttgaaaacagcctaggcaacatagtgagaccttgtctctaaaaaatattttttaaaaattagcagggcatggtggtgcacacctgtagtcccaactacttgggaggctgaggtgggacgatcacttgagcctgggagttggaggctgcagtaagctatgatcatgccactgcactcctgcctgggcaccagagcaagactccatgtcaaataaacccctcaaggccgggcgcggtggctcacgcctgtaatcccagcactttgggagaccaaggcgggtggatcacgaggtcagcagttcgagaccagcctgaccagcatggtgaaaccccatctctactaaaaatacaaaaaaaattagctgggcatggcggtgggcacctgtaatcccagctacttgggaggctgaggcagaattgcttgaaaccagaaggcagaggttgcagtgagcctagattgcaacactgcagtgtagcctgggcaatgagagcaaaactctgtctcaaaaaaaaaaaaaaactctcaaaataaaaaacctaagtgcgcaaggccatccactcagatacaccgccccacacatcagcgtcccaccccttcactatcaggctgtcactttgctgtgagagccttgtttaggttgagatcccctgcttctcctggagttcggctgtgctccactaacccccggggcctcatcttcatttctgtccacccgccggccagtctctgcatgtgccagctgggctctgatgcggggcactctgcttcatgctgttgatcggtgtgtctggatctgtcatgttctctcctcaaggaatcaacagtgcttagcaacagcctctcagtcccatggctcttggagttcctccccacctctcaggtgcccagggcactgcaccagtgacactgcctccaaatgtctcccatcccagttccccctggtgacagttcttactgtcacactgtgacccaggccgggggctgtcagttctccacctgacaccttggcatctacgaggatggaacaccacaaaatgctggaaacacgagaagagtgacagctcctcgttgccaccctgccggcgcaggagccaatttcagagtgctgtccttcaggtgggcttcccagggccacccaccagacacccactgttgaggtcgagttccctagaagcaaagcctgaagcaaggattcttgttctcgggctgttgctgagcgtgtgcccaggagagtgaggaagtctgtgctgccttccggtggtgctgagccctgaacggtttccaacaggagcttacttgttcatacttccagaggtcaggaacccagatcagggtgtcagcagtgtcgtgctctcggaaggctccaggggacagtctacccggtgcccttctcccagcatctggccttgctggacccactgggcattccttggctcacaaatgccccctcccatctccaccttggtcaccacatggtcttctcctgtatgtggctcttctcttctgaggacttcatcagtcttactgggttaaggacataccctactccggtatgacttcatcttcatttgcatggttcttgttgttgtctggtttacaggcagggtcttgctctcttggccaggctgaagtgcagtgatgtggtcacagctcagtgcagcctcaaccttctgggctcaagcaatcttctcacctcagcctccaaagtagctggtaccacagatgtgtaccaacatgcccagctagttaatttaagtgtaattacatctgcaaagatcttatttctaaataagttcacattcacagataggatgagcgaggactttggcatctctttgggagacacaacagaaacctagagggactccccatcctgatttgcctgtgactttcccaggttttggtgctgacagccctgctttccgggaaattccttagtcttgggaaaactgagatgcctggtcaccgtggaagtaggacagggctgggtggtagagtgcagactgctgagcagaaagctgtctctgttacaggtcagttttcatcattccacatggaaccgctgtggcagacactgagaacttcacagatctgaaccacctttcggcaaagcagggatgcccaggtatcagccattgtcagggttctgcctctgggtctggagggctgctgtgtgggtggctctcattccccaggacaattctccaagaccaaggtggccatgagccaccaggaggcaacagtcagcagctggggaccagtaggctgacccctaaaggggatctgaatagagccatctatgcacacccatccccttgtcttcccagtaaatggcccgcggccccacctactcacctgggtaaacacacacctcgactcctgtgcaccttggtaaacacacacctgtccgtccaggtaaatgccccactcactcacctgtgcaccttggtaaacacacacctgtccgtccaggtagatgccccactcactcacctgtgcagcgctcacctgactctagagctgctcaaggctcagctggtgggcaatgcttagcactccctactcccacctcggatctcatcgtccacctccagctccatctggtattgcccacgcctgtccctctgcactgcctccaccttggcgccagtcgtagatgtctgccaccggcacccccacagtggctggcttttgaacccactcccagcaacttttctctcctgtcctcctccccaaagtgagcctccccgagaggcgtcaatgcttgccacaaacagaagtcccatcatggcaccctcacttcagatgcccggagtgagtggtcctcagtccctggaagccctggactctgccacctctcccatctgtcccctccctcctcactctcagctgcccaggtccctggtcagctccttcaatgcatccaccctggctccttgacgccctatcctggggctcctggcacctctgcaagggggccttccctactgtccccacctgcacctctctagacaatcccagtgctcccggctgccaccatttctttccccgactaaagaacagacctgactgtttccaggactggatgaaactgaggcagatgaagagggcagggatctggaggggctgggggagaattagaggccacagaggaatggagctttgggtgggcacggacagaccactggatttggacagtcagggccgggacgcaggagcagctagggcccagggagccgggggttaggtccctcagatcccgcacatgcaaaagtgaggctgaggtaggggggtggtccctcggcatgtgagcccagggggttcccgagccaagtggcagccggaacagtggggagggacagccaaggaggtggggaggggtcgctggccccgctcagggctggttggggtggaggaagcccgggcccaggccgccccccgctgggtcgaggccaccccgcctcgagggcgcggccgtccggatctcctgattgctttctttcatctctgttcctttctcagccacaaacgcccgctaatgcctcttttatcacggaattaggggatttagggccggtcgcacaaaggggccctcgatagcggccataatcaaaccccaatcggccgaccttggacgggccggggaagaaaggagcgccggggattagcgcggtaccgcggccgggcaggcagagatagcatcggcgccgctgcggggctgaagccgcggagggctcggccgcgctcggagaaaggacggcttagctcctggagccggggattctgaagccattaggtggggattaacacccaagttaatctgctttggtcgctcaattgtcagcagcgaacgcgcgggactgaggaagcctggctcccagcgaccacagggccttgccacccagcagtccagagctacgagctggtatcagtttccccagctgtcacccggccaaggcgggccttggagccaaaagggagatgcacaccttggtgggctggccaacgggtctggatgagtggaccccctgccccgccagccttcctgggtaatcagggaactcagagaaggatgttcctgccccatcctgacccagaccacttgtggaccctgacagccagtgcagccctgggtgccacccacacactgagcttgggttgcacggcaacatgcatgacacacctgtccccatcaagcagggtcagggggcagcctgcagactgggtggacgctgacagcagctagcagcccccttgcagaccctccatcttccctttggggtccctgtccaggtatagccccctaaagacctctgttgaccaactcactgacagggcagatgtgacaccacctgctctcaattcatcctcactcttcatcttcagtcctctctcactaggcggcagagggagggactggacctatacaggtcccaggtaggtcctttgtctctgtctgggttttcctatctgaggaatggagccggctaaggaaaggcccaaccagaatgtgccagtgtcgtgtgtggcctgtgctcactgctatcttctgtggggacgcaaccccaaccctgactccttctcctgttcctgccagcaggcccccagagtaggtggctcagaggggtgtgcttacacctgcctcctcctccatggagatgtggcaaggtcactgtgccttacatgagcctacaggcagcaacaagtggctggactggagctgaccaggcaggcaggatggggtgggcagtagcagaggagaggccagtggagcgctctgggtccccatcttctttcccatggctgagactagggacattggaacaaaaagtcccaagtggaggaaaagacgcagtcataagtacatttgtctttccttccctctcatctcccttcctccctttcttccttcagcagtgaccaacgattctcccatccaggccctgtggaggggacacaggcgtgagccacagacccaggctctgccctctgggagcttgggtccgaggacacagttagacaaccggatgggagggcgcccttcgggaaggggaaacaggcaccccacatgcacagggccaggcagggcctgaagggcagtgtgaattacagggaaaatgcggagggagaggaagagtgctccagggcgaggaagccgcgcccgcagcgatctggagtgcggtggggagcaggtgaggcgggagaagcccagttctgggacacgcaggccagctctaggcaggggaaaggaggggcgggaggccagggaatgttccctcaggctggtgcgtcagaatggcccaggcagcctccagcgtgggcccccgctggtcccgggaggcgccgccagaggctcggggagggtggacgatgtggctgggccggcgagaatccaggggctgcaggcaaggacggggactcgcgatgaaacccgaagatcaggggctggtggcagtgaccgcgaggggcctccaagcagcccaatcaatctcggacgaggggtcgagtcagtggcggtgcaggcggcaaaggcagccagggtctgagcagcgcggctccagccccagcagcaacgggagagcgcgtgcgccgccccagacgactggacgcgccctcgtgacgccatcagcgcgcgccgccccaacttccgagcgcaagcgtggtcgcccccacagcctgtgggctacgggaacgcgatccgactcggcggccctccctgcctggatggccggtccccgaggctgaggaagtccattcctctttcggaaatggtccccaggaagcttctccgtgtccccctatggccgggtactgagcggggcccgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctgggcttctcagggagccaacactgtggccacagctgctctgccctgggtggacactaggctttccctgtccccctactgcagtgtcctcagatgggggtggcctggtcccctgcagaggcacagccaccaatgcccatgcatagatgggtccatacagggacgaacacaggacaggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccaggccccgcccccagcccgccccgtgcgggccgggaaactgaggcctgggcggggcgcgccgaggcaggcgtaggggcggggccaaagcgcagccaatggccgaggccgagtccctgggcgaccgcgagcggcgggacgggggcggggctgcgggaggcggagccgtggcccagctccgagcagtgggtcaaggtgcactgtgtgccgcgccgcgggatagcgggcctcgggtctgcgcgactgtcgagagcggcgggatccccagggatcccggaggccaggggcacaccctccccgaaaacacgtggggctagcccagtcccagaggaactctaacgtttcaaacctggaggcgggaggcgggaggccggtgagaaggggctacgccgccgggcccccctcccgcagcagccacgggccgggcctcacctgccggttcccacccacacctttcccggttgtagtttctgcgctcagcgaacaaggtcaggaaagaccacaaatgcaagcggctgtattctcctaggcagcttgtctgggcaacggaggtcccacaccccaaagaggacccagcaaatctttaatggactgcggggcctaggaaactggcccgtccctcctacccataccagcaccaagcagagcacctttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggtggcgacggcgcaggcgcagtgccccgagctcccggtcctggcccccgccctcctccctgaccgcgccccggcccgcaccccctttccccgccccttcccccgcccctgccccgcccctgccccgcctctgccccgcccctgcccccgcccctgcccccgcccctgcccccgcctctgccccgtcccgcctgcgcggatccctccgcccgctccgagggtccgcggaaagtagtcccgcgcgccctctgccctgacgcggtgtgtgccagctacccgagtgaaaggttttcgggggattaatcctgatggggtctgcggcggcccttgcccagcgccttccacatgtggagcgggccagtggtgctagttctgccgccaactctggacggttgagttcagggccactttttactcaggcacggatgtgacagaaagatggaaaagggtcttggaagaaccacatgtgccgtataacgaacgaccttttggtctgaggaggaccgtgtatatgacggtggtcccataacatgataacggagctggaaacttcctgtcctctggtgagggcttagctaaggacatttcctctcctgtatttggagatacacgtacaggtatgtcattaccgtgccaggggaataacgcacctcacacgcggtgcgggtttgcggcctagcagcagcggaccgcatcagctgcctagttgtgtagtggctgtgccatctgagtttgtgtaagttaccttgtgatgatcccacaaccgagacgcatgtctcagaatgcatggatgcatgggacgcgtgactgtacgtgttacagacgtgtttcggcgtgaggctcggcccctgctcctttaggaaacacctttcctggctcatgcggtttctagagaacactgtgtcggaatatcaatgtagagagtcagcgaaggtcatctagcagcagatgaccagccccaggccagtgaggatcacccagagtgcccgtggctgcacgacagtagtagcaggtggaagctggagcccacacctggtttgcccagcagccagttgtttttccgaggcaccgttggctgatgttttgcatacagatgattcagctgcataaaagatgtctgtcaggaaagggaagcccttggcattcagcacaggcactccctacggggtaatcgatagccgtctctgctgcttcccatgttgctcactggtaattttaagaaatgaacggcccaccttgaataagacaaggatggtgcaattatttgcgcaatggcttgaccatctagtagccaaaaatatgttaaggaatagaacagactgttcactttcaaattaaatctcttttccagtattagccaagacctctgcagcccgccctttctaaaatccatgtggcctcatccgctaaatatagagctgggttttgctgtggttagtactacatttcccaaatctctttattttggcaatgatgcctgtgactccaagtaccctttaccccaaacattatataaattttttagtaattaataccatcactccctaaatcaccttccccagggctttttggggattaaaactaaaattttataccctaaaagaaagaatttaagaaaatcatagttaagcaaagtgacaggattgttaatacgtcgggacctcaagtggggattaagtttcaacattaattttagaggagacacaaatctttctgtctcttcaaaccatagaagagacagaaagcacaacagttatttgaatagacagaagtgaatataagtgatagttgtagttaacaggaaataaagttgttaatatacttgtaaaaaaattaaatgttctgacttgaaagggactttaatattctcaccacttgtaggtaacttgctaagtaaccctaaaaaaacctttcaattcttttttttttttttttttttttgagacaagagtctcgctctgtcgcccaggctggtgtgcagtggcacgatctctgctcactgcaacctctgcctctcaggttccagccattctcctgcctcagcctcccaagtagctgggactacaggcgcacgccaccgcacctggctaatttttcatttttagtagagacagggtctcaccatgttgaccaggctggtctcaaactcctggcctcaggtgatccatccacctcggccttccaaagtgctgggattacaggtgtgagccaccgcgcctggcccgggattaagtttcaacattaattttgaaggggacacaaaccttcaaaccacagaagagagagaaagtgcatcagttatttaaacaaagggaactgaatataaacaatagttaacaggaagtaaatttaaaataataaaaagaaaatcccaagatatggagttacaaacataggacacagctaccacccctagagctcaaagatgaaagagaagctggaattattacagcttaaaggaagggcttgcagagctggaattcagatctctgaggaggtgtgttgaccagctggggctggggtcattgagcccagaggagagatcccatggggatgggactcagacctctgaggagggtccctacgggacttagacacacactatggatgaggggtggctgtggagctgggagtaagccctctaaagagggcactgggagactctcacccagatctctaaggagaaggcatactgaggctggttctgcaagtcttggaaaaacttaaactggattcagcttctgtgggaagaatgtgctgctgccttgttgaagaagcctagctggggtgatgctcacaggaagtggccctgtggtctccctctatcaacctatcagcttagtctaatagggaatattagatcagatcttctttatttgccaatgagaaatatgttttttagagtctcagccctggcatcagaagcagtgtctagaggtgggaagggagaatagagctgaaagacattatttaataactggtacaagaaacgacatgttatagctaaattccaattcccatgggactttcctataggtggaattgaaaagtctgtggaggcgtataatcgcagcgctttgggaggctgaggtaggaggattgcttgagcccaggagttcaagaccagcctggtcaaccccatctcttcaaaaaaatttaaaaattaacagggcatggtgatgcatgtctataggcctagttgggaggctgcaacaggaggatcacttgagcccatgagctcaaggttacagtaagctatgatcgtaccactatactccagcctgggcaacagagaaagaccctgtctttaaaaaagaaaaagtcactggaggactttagttttcagacagcttcagagaactaaaaaggcagtgaataattatgaggccaatatcagagagaaaggacatgagagaggtgagtggtttatggctgctttttcttgaaaggcatctgccaattccagatgaatgtttgagacactaggactctgagcagcacttttaacactctcattgccctaggacgacaaaatttggaggcttggtaccaccaaggaggtatcccactgtactgttttgggaccacaagttgtttgggactccattcaaatcatgtcagtccttgccagcagcaaatgtaaatcttccctgggaatgataacctcatccatggtctcaaattacttctacaattgttcatatgcagtgttcaacactgaatcaaaaataagtaggcatccaaggagaaaagacaaaatggttgcaaaaaacaagagcaagcctggacaacatagtgacaccctgtttctaaaaaactaataataataataattagctgagcatgcacctccagagtctgaggcaggaggatggcttgagcccaggaggtcaaggctgcagtgagccaagatcacactgctgcactctagcctcggtgatagaatgaggccctgtatctgaaacaaaaacaagaacagtaacagacaagtgagctctaggggatcaaaaaatggagttttcacaaagacttttaaataattatgcttaatatggttaagaggataaaagacaaggttaagaattttatcacaagcctgtaaattataaagaaccaaatggaaattctagaactgaaattgtgaaaattcaccagatagtgttagcatattacacacctctgaaaagagaaagctagtgatggtagagttaagtcagaagagtatatctaaattaaagcacagagataaaaggacagaaaataaagcatatgaataaattagatatagaggatacatgtagaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggcagatcacttgaggtcaggagttcgagaccagcctggccaacatggcgaaaccccatctgtgctaaaaccccgtctctactaaaaatacaaaaattacctgggcatggtggcgcatgcctgtagccccagctactcaggaggctgaggcaggagaattgcttgaacccgggaggcggaggttgcagtgagctgagatggcactacttcactccagcctgggcaacacagagtgagactctgtctcaaaaaagaaaagggaagggaaaggaagggagaaaggaagggagggagggaagaagggaaaggaaaggaagaagagaagaagggaatggaagggaaaataaagaaaataatgacattggcagacaaacaagatctgagaaaatttgttaccaaaagatctaaactaaaggaaatactaatgggtttttatcaggtcaaaataaaatgttctcaagtggaagctcagagatatagaatggataaaattcaacaaaaagtatatattggtaaatctaaatgaaagttaactgcatgacacaaaaataataaagccttctgggattaaaaatatgtcagaatttaggccgggcgcggtggctcaggcctgtaatcccagcactttgggaggccgaggccggtggatcacgaggtcaggagatcgagaccatcctggctaacatggtgaaaccccgtctctactaaaaatacaaaaaattagccgggcgtggtggcaggcgcctgtagtcccagctactcgggaggctgaggcaggagaatggcgtgaaccccagaggcagagcttgcagtgagccaagatcgtgccactgcactttagtctgggcaacagagtgaaactctgtctcaaaaaaaaaaaaaaagtcagaatttaaatatataaaatctatagtaagtcagaactggggtaatccaggcatcatctgagaaaggggtataaaaaaggttagatttgtagttgattgaataattggtcccaagtcttaaggccttgtaagagttctattcctctgcactcttgccatggctttgtagtggattgagggtgcttcttcaccccttggttccaggtttcaccctgtgccttgcttcagctcattggatgttagaagtgtgatatgagcagaaatttaactgtcccacattgtttggattgcactcttgcacttctgttgtgtccgtgagtacaatttgtcccccctagccattgccttttgagcttggagctcaggatggcatgtataaagtagatctcagcccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactacccttgtatgaaaaatgtaattctgttaaatttctttgtttgctgcctatataagtaagaccataacctttcagcttgggatcactgaccccattcctttggggtctgtatttccggatattcatcctcaactttgtgcttgcataaactcttaaactggattctgatgctttaaattatttcaggttgacatactagtgacccagatgggacctgaagttagcttctgccactgactcctgctgttttgctaacagataggtggtaccagtacagactgttgctggagtttatgggagccctaagtgagacccctcttgcattttgaatctccctggcttagatgagattcgtatattgttcaaatgacctgattccatactcaatggggctggaattaaagttctactttaaatctttaaggtaggagtttcatttcttatctctcgagagattctgttgtttgcaggtttacggtttcattcttttttaaggttaaggttttgtttgccttacttgctaaagtttgcaaccttttctctcatgcaaaatctggttaaaggaaaagcagtttccctttaataagatatgaatttctgtggcttaagcaaaattgtgaccttaaactagccaggttttgaagctcagttcaatttggcacatttaaattctttttttgagtgaccaaaaatttataaaagacctttattggctgggcacagtggctcactcctgtaatcttagcactttgggaggccgacgctggaggatcacttgagaccaggagttcgagaccagcatgggcaacatagtgagaccctgtctctgcaaaaaaataaaataaataaaaataaaaaaaaaataattaattaaaaaaaaatctttatgagaatgtgataagtcctgaaggcaacgtacactgttcatcctgaccaaaaggcaccttaggtgactgaggtcttgtaggagtgccagagattatcacttgtgatgagaaatggtcacacaggggatccccaaagaagaacatacagggaaatttgcttaaattcagtaaatatatataaggtactgatgtcccagtgccttaagctcccagaatttctgggtttcactgagacacataagaggaaagaactgatccaagggtaacacacgggggagctattcccataaataatacatttgatccaaaacatctttccctttcacttaagaggagaatacaaattataggcgatcagctatctaaaatagagtcctccttgtggagaggtccatctttagagactccagctggatacctgtacagtacttacggttttacttcttgtcattatttagaaaaattgtctcttgaagaactcacgaagaaccaaaattgcaatggccaaagtagggtactttgaaatgcctaaactaaattatttgtgtgctcaattagaaaaatccggttctggccgggcaccgtggctcacgcctgtaatcccagcactttgggaggccgaggcgggcggatcacctgaggtcaggagttcgggaccagcataaccaacatgcagaaaccccatctctactaaaaataaaaaaaaattagccgggtgcggtggcacatgcctttattcccagctactcaggaggctgaggcaggagaatcgcttgaacccaggaggcggagcttgcggtgagctgagattaggcgtcattgcactccagcctgggcaacaacagcgaaactccgtctcaaaaaaaagaaaataaaaaagaaaaagaaaaatcgggttctaggataaaatagaataattgggagatttatttttagaggtatttagaagcatccagaagaggttctgataaagttacttcactgcaggaggaaaataaaagattgcctaaaggctgggcacggtggctcacgcctgtaatcccagcactttgggaggccgaggcaggcggatcacaaggtcaggagatcaagaccatcctggctaacacggtgaaacccccatctctactaaaaaaatacaaaaaaaaaaaaaaaaaaattagctggacgtggtggcaggcgcctgtagtcccagctactcgggaggctgaggcaggagaatggcgtgaacatcggaggaggagcttgcagtgagccgagatcgcaccactgcactccagcctgggcgacagagcaagactccatctcaaaaaaaaaaaccaaacaaacaaaaggtagtcaactggcataaaatataaccatatatacaaaatccagagtcagttatgttatactttgaaagatgtaaaaagacttttagacaatattcaggcttatgtgaggtgagtgatgctaatcataaaaatgatactttcctgggctgggtgccgtggctcacacctgtaatgccagcactttgggaggccgaggtgggtggatcacctgaggtcaggagttcgagaccagcctgaccaatatggtaaaacctcgtctctactaaaaatacaaaaattagccaggcgtggtggcatgcacctgtaatcccagctacttgggaggctgaggcagaagaatcacttgaacccaggaggtggaggttgcagtgagccaagttgcgccattgcctccaccctaggcgacagagggagactctatctcaaaaaaagaaaaagaaaagatactttcctcaactccaactttatgaatgttctagataaagaattcactctaatagtaaagagacagtgccttagttgggccacttctcaaacccatgatttgattaatcttgctgacgggtcgttgtgtactttaaagaagaaaaagataaagaggccataccaaagaataaagtgagtaaagttatgaatttgcaactaaaacaagtatccaccaagtgtagacagtcaaaataccccaataaacctttgaacaggtctaatccttcaatctgtaataactacaataaaactggccactttccaaaaaagattactgaaaactaaaacagaaggaatgacaacagatgaaggaggaaaatacggaatagaggtgctccaagaaatttaaagggagctttccttttctgcttactaatattctgggaaaaatagaatttatttatttatttatttatttgagaggagtcttcgctctgtctcccagggagtgcagtggtgtaatctcgggctactgcaacctccacttcctgggttcaagcaattctactgactcagcctcctgagtagctgggattacaagcatgtgccaccatgtccagctaatttttgtatttttcgtagaggtgggttttcaccatgttggtcaggctgatctcaaactcatggcctcatgatcggtttgccttagcctctcaaagtgctgtgattacaggtgtgagccaccatgcccggcctcaatagaaattattttaagtaaagaacaataccaagtccttgttgatactgagcaacattatctgtaataaatctaaccttatcacaaagtcggggtaaacatttctgagggtaaacactcggtctaaatggtaggtgtcacaaatacttccatatcagcacacaagtctcaccctgcaacttctcaactaggtatcttacaagggaatcatgttttccttttggttccatcagcccccatccatctgataggaagagacttcttaaaactatataatgcctatatttctttctcccagaagtgggaaatatatttagaattagatggtatggatgacacaacagaattaacagacacaagcaaaaaatttttaaaaatttaatccagttactatccatctcaccattgaggacactgaattattaagcaatgaagaattagaaaacctactaaaggtagtacttgattgattgtggtcaaagtccttcactgatacagaaactattgtttcagctacttcaataacatctcataatattcatcaaaaccccttccaaatatcagatactatcccacgataaccttaggaggggtaaaacctatgatttcagattatataaaaagaggactgatcaggctgggcacggtggctcacacctgtaatcccagcactttgggaggctgaggcaggcagttagtctgaggtcaggagtttgagaccagcctggccaatgtggcaaaaccccatctctactaaaaatacaaaaaaaaaaaaaattagccaggtgtggtggcatacacctgtagtcccagctacttgggaggctaaggcaggagaatcacttgaacccgggatgcagagattgcagtgagccaagattgcgccactgcactccagcctagtgacagagtgagactccacctaaaaaaaaaagaaaaaagaaagaaaaagaaagaaagaaaaaaaaggactgatcattctctatacaagccctcataatacaccaattccccgttaagaaaaccaaatggtagaggatggagacttgtacagaatttgatagcaataaacgacataattccacagcatccggtagtgcctaatcctcacacattgctcatatctattccattgaatgcagaatttattattttgtgtgtgcgtgtatcggagtctcgctttgttgccaggctggagtgcagtggtgtgatctcggctcactgcaacctctgcttcttgggttcaagtgattctcctgcctcagcctcctgagtagctgggactacagacatgcgccatcatgcccagctaatttttgtatttttagtagggatggtttcagcatgttggccaggatggtcttgatctcttgacctcgtgatctgcctgccttggcctcctaaattgctgggattacaggtgtgagccaccatgaatgcagaactttttacagtcatagatttatgcagtgcattctttagcattcctatagataaaactggccaatttctctttgcctttacttgggaagacagacaatatacttggacattcatgctccaggatacactgaaagcctcacttacttttcacaaacattaataaaagacctctcagatgataacttcattgagaagcctgtctatttttttttttgagacagtcttgctctgttgcccaggctggattgcagtgtcacaatcatagctcactgtagccttgaactcccaggctcaagtgatcctcccacctcagcctccagagtacctgggactacacaatacaagccaccatgcctggctaatttctggttgtcctttttttttttttttttttttttttgtagagacagggtttgccttgttgcccagactggtctcaagaaaactcctgggttcaagtaatctgcctgccttggcctcccaaaattctgggattataggcataggattataagcataccacagctttttttttttttttttttttttggagacagggtctcactctgtcgcctagactggagtgcagtggcgctattacgtatcactgtagcttcggcctcctgggctcaagtgatcctcccactcaggctcccaagtagctggggccagaggcatgcacccccatgcacggctactttttttaactttttgtagagatgcgctcttactatgttgcccaggctggtctcaaactcctgactgatcctgagtcatcctcccgccttggcctcccaaagtcaaagtgttggacttacaggcatgagccaccatgcctggctgagaagcctgtctgaatacaatacatagatgatttacgtctttgcttagataacaaataggcttccacagtagatggaatacacctgttacaattggccctaatggatcataaagtgtctaaagaaaaacttcaattttgtaaaaacaaaacaaaaaaaccaaaacaactacttaggccacctaatatccaaggaatgactttctattaatcccgatagattgaatgcaattgtagctgttctgacactgagaaccaagaaacagttaatgttttagggactagcagaattttgtagaaattatactctaaacttttctttaaaagctctgcccttacatgctctcttaagataagacatgccagactctctagattggacagaagaaattcaactaatattagaaatgatcaaaaataggttgggcgtggttgttcactcctgtaatcccagcactttgggaggccgaggtgggcagattgcttgaggtcaggagtttgagaccagtctggccaatgtgatgaaaccctgtctctactaaaaagtacaaaaattagtggggtgtggtggcacactcctgtagtcccaactacttaggaggctgaggcacaagaatcacttgaacctcaaagatggaggttgtagtgagccaagatcataccactgtactccagcctgggcaacacagtgagactctgtctcaaaaaaaaaaaaaaaaaaagaaaagaaaagaaaggagaaatgatcaaaaatgaccttgctaacactccagctttggggcatccaaattataacatttcattatttgtgtatgaaagtggtggaaacaacactttaggggtcctaacccaaaaaaagagttcaaaatagacctatagggtattagagccaacaattagacactgtagcaaaaggactcccaccttgtatgagagccataacagccaccatttgttcattagggcaactgaagaaattgtcatgggaacaccccttactatcttcatcccttattctgtggaggtattgctatactcacgccatacttaacattattcagttagtagactggcttcatatgagatgttgcttattttagcttctcatatcatcatctctagtgtaacgatgtaagccctgcattcttttgccttcatttttacatgaaatgccacacaactgcatagctctaagtgatcaacatttttcttctaggtcagacctccaagagactccctttatgaatactgatgctatttggttcacagatggatgttacttgaaggatgaatcttgaatctaccaagcaggttgcactataatgtctttaagtgaggaaatagaaagtgcctattttctgaaagccatctcagctcaataaaaggaattaatagcattgaataggcctgtcaattggcaaaaagaatatgtgctaatatttatacagacagtagacatacttttggagtagcccatgatttggaaatgttatagaagcaaagagtgttcgtaacctcttaaggccaatccataaaaaacaaacttcttatttcatgactactagaaaaaatccctggccattattaaaattttgggtcattccaaatcagatactccagaaagcagaggatatcagctagctgataagtagcaaatagagctgctctaaacacatctaaacaagagaaccaacctgtgttaacttttaaggaaggacctgaatttgacataaaattagctcaattcagagccctaaaatcagaacaaaaagattgggaaacaaaagggggggaatagattccccaaaagatgaggtatggtatgggccaaacaagttgcccgtactttctgctgaattttagttgttattattattttttttgagacagagtttcactcttcttgcccaggctggagtgcagtgatgtgatctcggctcactacgacctcttcctcctgggcttcagcaattctcattcctcagcctcccagtgaatggagttttgctcttgttgcccaggctggagtgcagtggcgcagtcttggctcactgcaacctccacctctcaggtcaagcaattctcctgcctcagccaccacacctggctaatttttctgtatttttagcagagacagggttttcatcatgttggccaggctgatctcgaactcctgacctcaggtgatccacccgccttggtctcccaaagtgctgggattacaagcatgagccactgcgccctgtcatttccacattttttaggtatttcttacaagcagcaccccactcctcacgttaatctcatctagaaatgcccttacatacacagccagaataacgtttaatcaaatatctgggcactgtgtgacccagtcaagcaagttgacacataaccatcataaatatcaaagtatttgtggaaatattttaaaaactgctacaacatgtatattggcctggtgtggtggctcacacctgtaattccagcactttgggaggccaaggcaggcggatcacctgaggtcagaagttcaagacgagcatagccaacagggtgaaaccctgtcttgactaaaaatacaagaagaagattagccagccatggtagtgcacgcctgtagtcccagctactcagaaggttgaggcacaagaatcgcttgaacctggaaggcggatgttgcagtgagctgagatcgcaccactgcactccatcctgggcaacagagtgagactctctctcaaaaaaacccaacactgctacaacatgtgtataggtttccttgtgatatatttatatttacaaaatacatacttacaaatatatacatctgtatttactaaaacgtgattttttaaagacagaatctcactcacattgcccaggccggagtgtagttgcatgatcatggctaactgcagcctcaacttcccaggttcaggtgatcatctcacctcggcctcccaagtagcagagacaataagcatgcaccactacacctgactaattttttaattttttgtagagacagggttttgccatgttgcccaggctggtttcgagctcctgggctcaagccatctacctgccacagcctcccaatgcgctgtgattacagccatgagccaccacactcagcctcaaaagtattttaataagagagactagaaaatatcttcatggaacagttaaccataagaaatgacccaacgagccagacatggttgttcatgcctgtttattgatttggtatcctgctactttgctggattcacttcttagttgtaaccactgtgtatgcatgtgtgtgtgtgtgtgtatgtgcgtgtgtgtaatccttgatttaagattgtgtcatctgtgaacacagatcatcttttttcctttccaatttgcatgccttatatttctttttcttgtctaactgctgtggctagagattccttcctatgtagaatagaagtggcaagagtaggcatccttgtcttcttcctgattttagtggaaaagcttgccattattgtgttgaggcaattttcttctattactagtttgttgagtgttttatcataaaagactgttgaattttatcaaatgctttttctgcatcattgagataatcatgtagtttttcccattcattctgttaatgtcatgttttgggtgaagtaatctgtttacgcctgttaggtttaattggggtttattgtgttaagtcctctgtttctttagttaccgtctcatctgattgctctatacctatcattgaaatttggcagttgaaggccgggcgtggtggctcacgcctgtaatcctagcactttgggaggtgaaagcgggtggatcacgaggccagaagatcgagaccatcctagctaacatggtgaaaccccatctctactaaaaatacaaaaaattagccaggcatggtggtgtgtgcctgtagtcccagctactggggaggctgaggcaggagaatggcatgaacccgagaggcggagcttgaagtgagctgagatcgtgccactgcactccagcctgggcagcagagtgagactctgtctcaaaaaaaaaaaaaaaaaaaaagaaagttggcgattgaagtctctaacaattattgcagaactatctttttcccttcatttctgtccatttttgcttcatatatattgagggtttgctattaggtgtgtaaatctatatgattcttatatcttattgatatattgaaccgtttgttaatatataatattcttatcttttgtaatctttttaatttaaagtttattatatctgatattagcatagccagtccagctgtcctgtatttaatatttgtataggatatctttttcaatccttttacttttaacctatttgcatctttaatggaaagtgaacatctcttataggcagcctgtatttaaatcatgtgtttctagccaggcatgttggctcacgcctgtaatcccagcactttgggaggcctaggcgggtggatcacttgaggccaagagtttgagaccagcgtggccaacatggcaaaagcacattggtactaaaaatataaacattagctgggcgtggtgacacgcaccttcagtctgagctactcaggaggctgaggcatgagaatcgcttgaatctggaaggcagagtttgcagtgagtggaaatcatgccactgccagccagcctgggcaacagagctagactctgtctcaaaaaataaataaataaataaataaaataaaaatcatgtgtttcgattcttctgctaatctctcatttaactgggaattttaattcttggtattttgctatttgttttctatatgccctacagttgttgtttttttttttttttgtacctcatttccttcattactatcttctttgtttagtttattttaaatagtgaaccattttgattcccttctcatttcctttttttgcttttttgagacagagtctcactctgtagtccagtctggagtgcaatggcacaatcttggcttattgcaacctccacctcccaggttcaagtgattctcatgcctcagccccctgagtagctgggattacaggcgtgtgccaccacacccggctaatttatatattttttagtagagacagggtttcgccatgttggccaggctggtctcaaactcctggcctcaagtgatctgcctgccttggcctcccaaagtgctgggattgcaggcgtgagccactgtgctggcttctttttccccacctttttttggagacggagtcttgtactgtcgcccaggctggagtgcagtgatgtgctcttggctcactgcaacttccacctccagggttcaagcgattctcctgcctcagcctcctgagtagctgggactacaggtgcccaccgccatgcctggctaattttttgtattttagtagagaccaggttttgctgtgttgtccaggctggtcttgaacgcctgagctcaggcaatccacctgcctcggcctaccaaagtgctgggattacaggcgtgagccacgacgcccaggcttttttttgttttttttttgagacagtttctgtcacccaggctggagtgcaatggcatgatcatggctcactgcagcctcagtcttcctcagtctccttgaggtgatcctcctacctcagcctcctgagtagctaggactatagacatgcaccactacacctgattaatttttgtacttcttgtagaaacagggtttcacgttgttgcccaggctgttctcagactcctgggctcaaggaatctgcctgtttcagtctcccaaagtgttgagattacaggcatgaacgactgtgtctggccttcatttccttttgtctacaatttatagattttttgagataaccatgggaatttattttaacatcctaaatttgaatacaattttaacttcaatactgtataaaactctgcttctgacagggcgtggtggctcacgcctgtaatcccagcactttgggaggccgaggcgggtggatcctgaggtcaagagattgagaccatcctggccaacatggtgaaaccctgtctctactaaaacatacaaaaatttgctgggcatggtgacacacgcctgtagtcccagctactcgggagactgaggcaggagaacagcttgaacccgggagacggaggttgcagtgagcggagattgtgccactgcactccagcctgggagacagggcaagactccgtctcaaaaagcaaaaaacaaaaaacaaaacaaaacaaaaaaactctgcttctatacagctcattcctcctactttcttttattgatgttacaaattacatctttatatattgtgtgctcagtaacattgactaataattgtatttatgcatttgtctcagaaatcatgtagaaaataaaaagtggagttattaaccataattataataattacccatgtatttacctttaccacagatatttatttctttttactttttatttatttatttatttatttatttttgagacaggttctcgctctgtcacccaggccagagtacagtggcaccatcatagctcactgcagcctcaacctcccaggttcaagtgatccgatcctcccacctcagcctcttgagtagctgggactacaggtgcatgggaaccacacccagctcattttttttgtatattttgtagagacaaggttttgccatggtgctcaggctggtctcaatctcctgagctcaagcagtccactcacctaggccactcaaagtgctgggattacaggcatgagccaccatgtcttccctgtttatttctttatacagctttgagttgctgtgtagtattccttcatttctgtatggacttcctctgtcatttcttgcaggacagctctggtgttaataaattcactcagattttagttatctgggaatatctcaatttctggatcacttgaggtcaggagttcaaaaccagcctggtcaacatgataaaaccccgtttctactaaaaatactaaagttagctgggtgtggtggcatgcaactgtagtcccagctacttgggaggctgaggcaggagaactgtttgaactggaaggcagaggttgcagtgaaccgagatcacgccactaaactccagcctgggtgacagagtgagactctgtctcaaaaaaaaaaaaaaaaaaaaaaggccgggcacagtggcttcatgcctgtaatcccagcactttgggaggctgagagagctgatcacgaggtcaggagatccagaccatcctggctaacgtgccgggtgtggtggcgggcacatgtagtcccagctactcgggaggctgaggcaggagaatggcgtgaaccgggaaggcggagcttgcagtgagctgagatggtgtcactgcactccagcctggatgacacagcgagactcctctgtctcaaaaaaaaaaaaaaagttaaccttcttacttagcaattctgtttcaaagcaagctgaaagatggaaataaatatcagaacataaatcaatgaaaatagaggccgagtgcagtggctcatgactgtaatccctgcactttggggggctgaggtggatggatcacttgaggtcaggagttcgagaacagcctggccaacatggtcaaagcctgtttctactaaaaatacaaaaattagccggccatggtggtgtgtgcctgtagtcccagctacttgggaggctgaggcaggagaatgacttgaacccgggaggcagaggttgcagtgagcagagatcatgccactgtactccagcctggaggacagagtgagactccatctcaaaaaaaaaaaaaaaaaaaaaagaaagaaaattgaaagcagaaaagatttagaaaattaaactaaaagctagttctaaaagatcaataaaatcgacaagcttctagcatgactgacaaagggaaaaagagtgaagaaaaaattaataggagttatcagtacagagcgtgcagacatcaaaaagataaggaaatactacaaacacctgtacaaacataatttgacaagtgagatgaaatggacaaattcctcaaggcaaagcaagacaaaacaaactcccactacccatctataatgaaatagataatccaattaatcatataactattaaagacattgaatttgtagttaaataatttttgaaatagaaatccacatccccagatggtttcactggataattctatcaaatgcttagataattaacaccaattctatataatctcttccagaaaacggaaagcaaatcacttccaaatttattttaaagttaagaaaaaatagtacatgctgggcctggtggctcacacctgtaatcccagcagtttgggaggctgacgtgggcagatcacttgagctgaggaatttgagaccagtgtgggcaacatggtgaaacaatgtctgtacaaaaaacaaaaattatccaggcatggtggcatgcacctgtagtcccagctacttgggaggttaatgtgggaagattgcttagacctgggagacagaggtttcagtgagctgagatcacaccactgctctccagactgggtgacagagtgagactctgtcttaaaaaaaaaaaaaaaaaagaagaagaaaaaggaaaaggaaaacaatacaaagaaagaaaactatagaccaacatgagtcatgaatatatgtgcaaaaattcttaacaagatatcataaatggaattcagcgatatataaaaataattatacaccattaccaagtggagtttatcccagaaatgtaaggctggttcaatgttcaaataccaatcaatgtgatccaccatattaacaagctaagtaagaaaaatcacatgagattatcaattgaattctgcagaaaaggcatttgacaaagtccaacacccattcatgataaaaaccaccagaaaacttagagaggaatttcttcaactgaataaaaaatatttaaagaaaaatcatgtggctatcatattcaataaagactgaatgctttttctctaagatcaacaacaaggcactcattactactattcaacaaaacactgcaagttctagacagagtctcactctgtcacccagtctggagagcagtggtgtgatctcagctcaccgaagcctctgtctcccaggtctaagcaatcttcccacattaacctcccaagtagctgggactacaggtgcatgccaccatgcctggataatttttgttttttgtacagacattgtttcaccatgttgcccacgctggtctcaaattcctcagctcaagtgatctgcccacgtcagcctcccaaactgctgggattacaggtgtgagccaccaggcccagcatgtactattttttcttaactttaaaataaatttggaagtgatttgctttctgttttctggaagagattatatagaattggtgttaattatctaagcatttgatagaattatccagtgaaaccatctggggatacagatttctatttcaataaggaaaaagaaatcaaaggtacaatagccaagatttggaatcaacctgtgtatcagcagacaaatggataaagaaaatgtgttatatatacatgatgaagtacttttcagccatgaaaaagaatgagatccagtcacttgcaacaacatagatgaaattggagaacattacgttaaatgaaatagggcaggcatagaaagacaaacttcaaatgctctcactcatttgcaggagctaaaactttaaataattgaactcatggagaatagaatggtggttaccagaggctgggaagagtagtagcattggggttggggggagtgggaatggttaatgggtacaaatttagttagaatgaataagatctagtatttgataatgcaacagggtaactacaatcaataatagtttattgtacatttaaaaataactaaaagaggccaggcgcggtggctcacgcctgtaatcccagcactttgggaggccaaggtgggcggatcacaaggtcaggagattgagaccatcttggctgacagggtgaaaccccatctctactaaagatgcaaaaaaaattagctgggcatggtggtgggtgcctgtagtcccagctacttgggaggctgaggcaggagaatggcatgaacctgggaggtggagcttgcagtgagccaagattgtgccactgcactccagcctgggtgacagagcgagacttcatctcaaaagaattaaaaaaaaaaagagtataactgaaatatttgtaacacatagaaatgataaatgcttgaggtgatgatggatatcccatttactctgatgtgattattacacattgaatgcctgtatcaacataaatatatggaccccataaatatatacaccttctatgtcctcataaaaattaaaaataattaagtttaaaaaagagtctaggcacggtggctcatgcctgtaatcccagcaccttgggaggctgaggctggcggatcacaaggtcaggagttcaagaccagcctggccaacatggcaaaatcctgtctatactaaacataccaaaattagctgggcatggtggcaggtgcctgtaatcccagctacttgggaggctgaggcaggagaatcgcttgaacctgggaggcggaagttgcagtgagctgagattatgccattgcactccagcctgggcaacaagagcaagactctgtctcaaaaaaaataataataataataattaaaaggcatactaatcagaaaagaagaaaaatttgtccctattttgagatgacgtgatttaactatatggaaagcccaaaggaataaaacaacaaaaacaaacaaaaaactcctaaaaaactaataagtgaatttagcaaggttgcaggatatatcaacatatcaaaattaattgtatttctatatactagcaaggaacacgtgggcactgaaattaaaatataatactatttataattgctccacaaaaatactttggtgtgaatctgccaatacaggtgcggaacttacatgatgaaaactagacaatgctgatgaaagaaatcaaacaagatctaaataaatggaaaggcatagcatgttcatggactagaagactcaattgtaaggacacccgttttccccaaatggtacacagttttaacacaattactatcaaaatccaagcaactttgttgttgttgttgtagatgcagacaaacttatactaaaatttgtttggaaacatacaagccctagaatagctaaaaagttttgaaacagttctgaggtgggaattaaagaaagaaagaaaaataaaattaaaaagagaaaaatatgttcaaaaaaacaagctttctgtattaggctggctcatcccaaagtcagtaacaggcaaagcccagacccaggcaaagtctcgataacattatctaagaagccagggctcaaaggaatgtgctctggagactctcccagcactccctccacataaggagaagaaaaacaaattttccttattttcctttcccctatggtatgagtacatttatgactttatagattcccgttttcttttcttttgttttctttttctttttttttgagatgaagtctcgctctgtcacccaggctggagtgcagtggtgcaatctcagctcactgcaagctccgcctcctgagttcacgccattctcctgcctcagcctcctgactagctgggactataggcgcccgccaccatgcctggctaattttttgtatttttagtagagacggggtttcaccttgttagccaggatggtctcgatctcgtgaccttgtgatccacctgcctcagcctcccaaggtgctgggattacaggcgtgagccactgcgcctggccagattcctgttttctgtaactagtaacctcaagtattctgttttttatccgagcagcacagcaaaggtcatgagacatgcctgagcaggcataatctaactgtcatagtttgattaactgcctttgttctgcttctatacacttgctttcacaccactacacttcgcatcactgtaaccttgtttcaaactagccaaccccttttcagaagtgtgtataaaagtcaagttctgtctttgttctaggcccggtctttggatgttaatccactaggccagagtgcactcaataacatccccctgttctacctattggtctctccagtctcctgattcccacaacagttccactggatctttcactgtctttgtagttttaccttttatagaatgtcacttaggtggggcgtggtggctcatgcctgtaattacagcattttgggaggctgaggcgggtggatcatttgaggtcaggagttcgagaccatcctggccaacacggtgaaaccccgtctctactaaaaatacaaaaattagccaggtgtggtggtatgcatctgtaatcccagctattcaggaggctgaggcaggagaattgcttgagcctgggaggtggaggttgcgataagcagagatcatgccactgcactccagtctgggtgacagagtgagaccctgtctcaaaaaaaaaaaacaaaaaacaacaaattgtcacttagttggaatcatacagtatgtagccttttcaaattggcttctttcacttagcaatatccatctaaggtcttccatgtcttttcatggcttggtagctcatttcttttcttttcttttttatttttctttgagatggagtctcggtctgtcgcccaggctggagtgtagtggcacgatctcagctcactgcaacctcaacctcctgggttcaggcaattctcttacctcagcctcgcaagtagctgggattacaggcacgcaccaccacacccagctgatttttgtatttttagtagagaaggggtttcaccatgttggccaggctggtcttgaattcctgacctcaggtgatctgcctgtcttgacctcccacagtgctgggattacaggcatgagccaccgtgcccggcctgagccactgcccccagccggctcatttcttatcattgaataatattccaatgtatgaatgtgtcagtttgttcattcaccaattgaggggatatcttgatttcttccagtttttgcagttttgaataaagctgctataaacattcatgtgtaggtttttatgtgtatataagttttcaactaattttggtatatacctaggagtgaaattgctgggccatatggttaggctatgtttagcttggaaggcactactagatcatcttccaaagtggctgtattctcaagagcaatgaatgagaattcctgtttttctatgtccacatccttgtcagcatttgatactgtcaggtttttggattttagcctatctaataggtgtatagtggtttctcattgttgtttttgttatttatttatttatgtatttattttagagatgggttcttactctcttgcccaggctggagtacagtggtatgatcatggctcactgcagcctcaaactgctgggttcaagaggtcctcctgtttctgcctcctaagtagctggactacaggcatatgccaccatgcccagctaattctcattgtgttctgaatttgtaattccctaatgacatatgatgtagagcgtcttttcatatggttatagccatatgtatatcttctttggtgagctccgttcagatattttgtccatttttaaactggaatgcttattttcttatttttgcattttgggagttattcgtatatattggatacaaatcctttatcagaaaagttatttgcaaatattttctccaagtctgtgggttttcattctcttagcaatgatgttctcagagcagcagttaaaaatttctgtctagattcttttttttatgtttgcatgtgtaaaatgcaaaacttcctgagtagaagggactacaggtgcatttattagagcagtatttattgaaaagactaatatttttctattgaattgcctttgttccttcatcaaagatcagttgatttcatttgtttgggtttatttatgggttctctactccgttcctttaccaatgtcacactgtcttgattactgtagcttcatagtaagtctcaaagttgagtagtgtgagtactctggccctgcttgtcttcaatattgagtgggctattctgcatcttttgactttccatacaaactttagaatttgcttgtcaatatctgcaaaataacttgctggaatcgttattggaattaaattgaatctataattggtaagcgctaacacattaatgttgagtcttcctacccatgaacatggaacttatctccatttattaatttagattttttatttatttcatcagagttttgtagtttccctcatataaagcttgtatgtattttgttagatttatacctaagtattttgattatttggtgtttatgtaagaggtattaaattttcaatttcaaattccaattgttcagtgttggttaaagaaaagcaatcaacttttgtatgttaaccttatatcctgcaatgtaactataataacttactagttctcagagttttttgttgattctttgggattttgtacatagatagtcatgttatctgcaattttttatactttatttccttcttcctaatttttatacttttatttccttcttttgtcttattgtattagctaagacttctagtacaatattgaataggagtggtgacaagagacatccttgccttttccctgatattaggggaaaagcatataatttttcaccattaagtagtgtatgatgttagccatacatacatacatagtggaattattgtagatgttcttcatcaattgagaaagttcccttctattcctagtttgctgagagtttttatcatgaataggtgttagatttgtcaaatgcttcttctaaatgtattgatataatcatgattttcttttttaacttaattgatgtgattgattacaataacttatattcaaccattaaacaagtatgcatatctggaatacatcccatttggtcatgttgtatttttttcatacaatgttggatttgatttgctaatatttttatcatggataaaaggggcattactatcgggtaaaattcagcccccgatatttcacctgggtccttttctattttccctaagtgttggctggtctgagaaataaagggaaagagtacaaaagagaaattttaaagctgggtgtctgggggagacatcacatgtcggcaggttctgtgatgccccccaagccgcaaaaccagcaagtttttattagtgattttcaaaggggagggagtgtatgaatagggtgtgggtcacagagatcacgtgcttcacaaggtaataaaatatcacaaggcaaatggaggcagggtgagatcacaggaccaatgcgaaattaaaattgctaatgaagttttgggcatgcattgtcattgataacatttatcaggagacagggtttgagaaaagacaactggtctgaccaaaatttattaggcgggaatttcctcatcctaataagcctgggagcgctacgggagaccggggcttatttcatcccttatctatgcccataaaagacagacgtccccaaagcggccatttcagaggcctccccttagggatacattctctttctcagggatgctccttgctgggaaaaagaattcagtgatatttctcctatttgcttttgaaagaagagaaatatggctcagttccacccggcccacaggcagccagactttaagcttatctcccttgttccctgaacattgctgttatcctgttcttttttcaaggtgcccagatttcacattgtttaaacaatttgtgcagaaaacgcaatcatcacagggtcctgaggcgacattcatcctcagcttacaaagatgatgggattaagagattaaagtaaagacaggcataggaaatcacaagggtattgactggggaagtgataagtgtccatgaaatcttcataatttatgttcagagactgcagtaaagacaggtgtaagaaattacaaaagtattaatttggggaaccaataaatgtccatgaaatcttcacaatttatgttcttctgccatggctttagccggtccctccgttcagggtccctgacttcccgcaacacattacatcacagtggaaagtgagatagtaaaggaatattatgaagtactctatgctcaaagggggcatgatccctatgacaaagggatccattcttcgagaagacataacaggctgggcatggtggctcatacctgtaatcccaacatttggggaggccaaggcaggaggatcatttcagctcaggggttcgagaccagcctaggcagtgtagtgagatcccatctacaaaaaaaaatttaaattggcctggcatggttgtgcctgcctgtagtcccagtacttacgaggctgagctgggaggatcacttgagcttggagggtaaggctgcagtgagctgtggtcacaccactgcactccagcctgggtgacagagtaagactgtctcaaaaaaaggggaaaagacatgaaaattactatatttcactgaagatttatgaattgcaaataagcacatgaaaagatgttgaacatcattaggtattacggaaatgcaaactaaagttacacctgtcaacatggctaaaattaatagtgacaacaaatgctggtgagcatgtggaaaaacttgatcactcatccattgttggaatgtaaaatggtacagctttgtggaaaatactttgtcatcttgaaaaaaactgcacttgcagctaccataagacccagtagttgccctcttgggaattgcttccacaaaatcaaatgcttatgttcacacaaaaaatttaatatcagggcttaactgtaatcaccaaaaattgaaactagccctgatgtcctgagcagatgaatggttaaatcaacagtgcagcaaaaccatgaaatactcattagcaataaataaaaactaatgaagtaataatatacacaacaacttaaattaactccagataattattctgagtgaaaaaaaaatccagtaggttaggtaagcatgacattgacataacattgttgaaatcaggaaattacagaaatggaaaacagattggtggttagcatgggttaagaaagtggaatggtgaaagggaagtggtgtggccatacgtgagcaacacaaccccacttaggtagaatacacatcttctcaagtagacaaggaacattctccagggtacagcatatgctaggttgtaaatcaaaccttagtaaatgtaaaggatagaaataatacaaagtatttttaaaaacacaacggaatactattagatcaataacagaaagaaagtcgagaagttgggaaacccacaaaggtgtggaaatttaacagcacactctaaatgaccaatgggtcaaagaagaaatcaagagggaaattagaaaatactttgtgggccgggtgcagtggctcacgtctgtaatcccagcactttgggaggccgaggcgggtggatcacgaggtcaggagatcgagaccatcctggctaacacggtgaaactccatctctactaaaaatacaaaaaattagccgggcatggtggcgggcacctgtagtaccagctactcaggaggctgaggcaggagaatggcgtgaacccaggaggcagagcttgcagtgagccaagattgcaccactgcactccagcctgggtgacagagtgagactccatctcaaaagaaattttataaaaaaactttttaattaaaaattaaagaaatactattatatatagagaatgagggtttaaaaaaaaaagaagaaatactataaacaattgtagcttagatgaaatgaacaaggccgggtgtggtggctcacgcctataatcctagcactttgggaggccgaggcagatggattacctgaggtcaggagttcgagaccagcctggccaacatgatgaaactccgtgtctactaaaaaaaaaaaacaaaaaattagccagtcgtggtggcaggcgcctgtaatcctagctacttgagaggctgaggcaggagaatcacttgaacctgggaggcagaggttgtagtgagccaagatcacaccactgtactccagcctaggcaagaagaatgaaactctgtttaaaaagaaagaaagaaagaaagacagacagacagacggaaagaaatgaatgaacaaatttctagacagacacaagcttccataactgactcagaagaaacagacaatccaaatatgcctataataacaaataatgagattgctttagtaataaaaaaaaactacccaaaaaaactgcgggcccaaatggctttactattgaattccaccaaatattttttttaaataccaattcttcacaaactcctcaaagaaaaatagaaaaggagggaatacttcccaactcattcacggattctataaggcaacatcaccctgacaccaaaaccaaagacctaacaagaaaagaactctttagacaatatattttataaatgtggacccacgaaaaccctgaaaaatacaatgacatgtaaaagtattgtataccatagccaagtgggatttatctcaggaaggaacagatggttcagcataaaaagtcaattaggctgggtgcagtggtcacacctgtaaccccagccctttgggaggctgtggcaggaggatcacttgagcccaggagttcgagaccagcctgggcaacatggtgagacctcacctctacaaaaaaaatcacattagcttggcgtggtggcacaagcctgtagtctctgctgcttgagaggctgagcaggaggatcatttgagcccaggaggtcgaggcggcaactgagccatggttgcaccattgcactccagcccaggtgacagagcaagaccctgtctttaaaaaaaaaaatcagccagccacggtggctcatgcctgtattcccaacactttgggaggctgaggcgggtggatcacctgaggtcaggagtttgagaccagcctggtcaacatggtgaaaccccgtctctactaaaataaatacaaaattcagccgggcatggtggtgagtacctgtagttccagctacttgggaggctgagacaggagaattgcttgaacccaggaggcagaggatgcagtgagctgagatagcatcactgtactccagcctgagtgacagagcaagacaacatctcaaaaaaaaaatcaattaagtagaattagaagggaacttcttcaacctaataaaggacatctgtgaaaagcacacaattaaatataatacttaatggtgaaagactggatgctttcctcctgaaatcagtattaagacaaggatgcccactcttggcacttctattcaacattgtactaaagggtttggccacagcaattaggcaagaaaaaaaaaaggcatccaggtaggaaaagaagtaatactatctctattcacagatgacatgatcttatgtaaagaaaattctaaagagtccaaaaaaaactattagaactaataaatgagttcagcaagattgcaggatataagatcaatatacaaaaatcaatgtatttttatacacttgtaatgaaatggaagtgaaattttaaaaacacttccttagccaggtgtgatatgtggacttggtagtcccagctacttgggaggctgaggtaggaggattgctggagctcaggagttctagacgagcctggacaacatagcaagattccatcttttgaaaaaaccaaacagctccacttacaatagcatcaaaaagaataaaatacttgggaatgaattttacaaaagaactataaaacttatattctggaaacttcaaaacattgttggaagaaatgaaagaaaacctaactaaatggatagatgtttatgttcattgattggaagacctgatactgttaagatagcaatctcctcagattaatctatagatcatcacaacccctagaactgcagctgatttctttctagaaattgacaaattgaccctaaaatttataaggagactcaggggccccagaatagcaaaaacaaccttgaaaagaacaattacattggaggactcacacttccttatttcaaaactttctataaagcaacagtaatcaagacagtgtagcatagacatatttcaacacaatacaactgagagtccagaaacgacccaagtgtctctggtctcctgattttcaacaagggtgccaagaccattcaatggggtaaaaatagtctttcaacaaatgatgctgggacatctggatggacacacgcaaaataatgacattgaactcttcacataatatacaaaactttactcaaaatggatcagagtattcaatgtaaaagctaacattatgaaactcttaatagaaacataagggtgaatgtgtatgaacttggatgtggtagtggtttcttaaatatgagatcaacagtgtgagcaacaaaagaaaacatttgagatagggccttagtctgtcacccaggatggagtacagtggtgccatcacagttcactgcagactcaacttccggggctcaagtgatccccccagcttagcctccctagtagctgaaaccacaggtgtgtaccacgattctggctaattcttttattttttgtagagatggggtcccactatgttgtccaggctggtctcaaactcctgggctcaagtgatccacctgccacagcctcccaaagtgttgggattacaggcacgagccatggcacccagctgataaggaatattttttatgcagaatagataaaaactctcacaaactcaatgataaagacaatccaattgaaaagttggcaaaggatctgaaaaataagacacacaagtgactaatatgcacatgagaggttgagcaacatatcagtcactagggaaatacaaatcaaaaccactctgagatatcatgttatacccactaggatgcctttacttaaaacaacctgataggctgaatgtggtggctcacacctgtaatcccagcactttggttggccaaagcaggaggactgcttgagcccaggagttcaagatcagcctgggcaacagcgagacccccgtctccataaaaaagtataaatatacatacatacatacttggtaataggaaatgttggcaaagatgtggaaaaattggaaatctcatacactgctgatatgaatataaaatggagcagccacactggaaggcagaatggtagtttgttaaacagttagttatagagtgatcatacggctcagcaattccactcctaggtctatatattatatatccgagagaaatgaaaacacatttccacataaaaacttgtacgctgatgtttatagtaccattatgcataattgccaaaaggtggaaacaatccaaatgtccatcaacagatgaacaggtaagcaaaatgatgcatacaatggaatattatttggtcataaaaagaagtggaatagtgatacatgctacaacatggatgaaacttgaaaatattatgctaagtgaaagcagccagacaagagcaatattctgtgattcaatttatatgaaatgttctgaataagcaaatctatagagacggaaagcaggttgatggttgcctcagaatgatggggatcggggatagggcatgataaagtgtatggggtttcttactgaggtgatgaaaagattctaataatggctgtggttaaagtgtatggggtttcttactgaggtgatgaaaagattctaataatggctgtggtgatggctgcacatatgatgtgactacactgaaaatcattagattgtaaatcgcatgctgttaactatttcagtaaagccgtttttttttttttaagcaaaacatgagccatccttttctttttttttgagagtctcgctctgttgcccaggctggagtgcaatggcatggtctcggcgcactgcaacctctgcctcctgggttcaagtgattctcctgcctcagcctcccaagtagctgggattgcaggtgcgtgccgccatgcctggctaattttttgtatttttagtacagacagggtttcaccattttggccaggctggtctcgaactcctgacttcaagtaatccgccggtcttggcctcccaaagtgctgggattgcaggcgtgagccactgtgcctggccataatcttttcttttttgagatggaatcttgctctgtcacccaggctggagtccagtggcacaatctcagctcactgcaacctctgcttcccaggttcaagcgattctcctgcctcagccacctgagtagctaagactacaggcacctgccatcacacctggctaatttttttttttttttttttttttttgtagttttagtagaggcagggtttcaccatgttggccaggctggtctcgaactcctggcctcaagtgatccacctgccttggcctcctaaaagtgctgggattacaggcgtgagccattgcacctgtcctgagccatcctcctgaggaaaacgtactccatcttgagaaaaaccaacagacgtaggaatagagtacctaggttatagagcaagtatatgtttaattctatgaggaacgatcacactgtttatcaaagtaactattcttcctaccagcaatgcatgagagttccagttgctccacatcctcactaatacacattattgtctttttaaaaaatgtaagccattctaatagatatgtgttgttactgttatttcttttgctgtacagaagctttttagtttgtctaatttgtctacttttttgttgtatttgcttttgagtccttagtcataaattctttctttctttctttttatttttttattttttttgagacagagtctcactctttcgcccaggccggagtgcagtggcgctatcttggctcacttcaagctccgcctccctggttcacgccactctcctgcctcagcctcccgagtagctgggactacaggcacccaccactgcgccaggctaattttttgtatttttagtagggacggggtttcaccgtgttagccaggatggtctagatctcctgacctcatgatccgcccgcctcagcctcccaaagtgctgggattacaggcgtgagccaccgcgcccagctttttaaattttttttgagacagtctcgcactgtcacccaggctgaagtgcagtgacgcgatctcagctcactgcaacctgtctcctgggttcaagcgattctcatgcctcagcctcctgagtagctggaattacaggtgtgtaccaccatgactggctaattttttgtttttgaggcggagtttcactcttgttgcccaggctggaatgcagtggtgcaatcttggctcactgcaacctctgcctcccaggttcaagtgattctcctgcctcagcctcccaagtatctgggatgacagccatgtgccaccatgcctggctaattttgtattttagtagagaggaggttttactatgttggtcaggaaacagtgtgatcattttgggtcttgcttttattttttggtaggtggatctgaagcagtgctgccttagtctccttggactctcagctccatttcctcagctcaagtagtccactgggctctacctcagttctgcctcctcttgctgtggcctagaaattctctctggatatcagaaaacaaaggacagtaatccctgccaagatgggatacaaacaaggtgagccccatgattgcccaagcgtactacctggagtgtcttcttctgtttttttctttttcttttttttcttcaagatgggatcttcctgtgttgcccaggctggagtgcagtgccatgatcatggctaattgcagccttgaactcctggcctcaaatggtcctcccacctcagcctcccatgtagctaggtctccaagcgcatgctactgtgcccagcatggtatccagtgtcttgaaaccaccattgcatgtatttttgacgggctcctttggttgtttcaggtagaagggtcaacctggtccctgttactccatcttgtctgtaagttgaaggccttgatgttttctgcttatctcttcatcatctccaaacggtggtggtaaagtcactcacgactgctgtttccttcaagggaggaaacgtgcgaagactttgcccacacaatctcaatttgtcctcataacgttgcagatttttttttttttttttttttttgagacggagtcttgctctgttgccgaggctggagtgcagtggcgcgatcttggctcactgcaacctctgcctcccgggttcaagcaattctcctgcctcagcctcccgagtagctgggattacaggtgtgtgccaccacacccagctaatttttgtatttttagtagagacgggggtttcatcatgttggtcaggctggctcgaactcctgacctcgtgatctgcccaccttggcctcccagagtgctgggattataggtgtgagccactgtgcccgaccccagtgcagatttttttagtctcaatctctatttgacagctaaaaaactgaggcccagatgtttgctggtttggagcccagacaggcctgttggcatatattgcttcctggagctccacaaagctcgcaatgtcttgctgcatagttgctaagggagctgcctcacctgcacagcaagtctctggctcttcattccttaagagtcccacttgcagcctggctttttatgtgtacacacacacacactcacacaaactatcctggctttatttggcatgaacacatgcctgggtctcatccagccacttgacatccgagtgagacatggagtggaatggctgctaggccagagatcagtggtcagttaccccggcctctgactccaagtccaaggctccttctccaggctcagacccacacactgggtggtggtgacaaagatcaggacccaggagtgggtggtactcagccctcactgtgcttaaagattctgtgattctgtttcttctcctgtagatcaacgtctggatcactttctaataaaattccaactttgctgataattctccaatatacccaagactgtaaatactgatttcctttcatgaaattgtccaaacagctgcagcccttggtgcacagtatgatctggacctggggcacagcaagaccagaaccatgaaccaccatgaaccatgactcctcacttgtgagatgacgtgtgcaaggtgacctatggtgcttcatgaccacagaagtgaccactctacactgtgaaatgaatttctgcatggggggtatattagggttctctacagggacagaactaatagatatatatgaaagtttattaagtattaacttacacaatcacaaggtcccacaataggccatctgcaagctgaggagcaaggagagccagttcgagtcccaaaattgaagaacttgggagtccgatgtttgagggcaggaagcatccagcacgggagaaagatgtaggctgggaggctaagcaagtctcatctcttcacatttttctgcctgctttatattcgttggcagctgattagatggtgcccacctgattaagagtgggtctgccttccccagcctgactcaaatgttaatctcctttggcaacaccctcacagacacatccaggatcaatattgcatccttcaatccaatcaagttgacacgcagtattaaccatgacaggggggaatgagatgacacaaaggatcccttctggctctcatgttctgtcaccatctacttcaggagagagatgcactgtgtggggaggatgaaagttagaaggaaaaggcaagagaaatcaggagggtttggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctggcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggattttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattgaggacattcataccatcagacaacatcaccaccatccatccatctccagaggtcttcattgcaaaactgaactctacccattaaaccataattccctgttcccctcttcccccaagccctggcaaccaccattctaccttttctgtgattttaactattcttaagtacctcacagaagcggaatcatagtgtttgtctttttgtaagtggcttatttcactgagcataatcctcaaggttcatccatgttatatagcacgtatcaaatttccttttcatggctgaattaatgttccattgtacgtacgccacattttccttatccatctgttgatggacacttgggttaccttccgcattttactattgtgaataatgctgctatgaacacaggagtacaaatatcccttcaagactgtgctttcttttagatatacgcccagaagtggaactgctggatcatatggtgagtctatttttaattttttgaggaagtgccatatggctttccatggctgctgtaacattatatattcccaccaatagtgcccaaggattccaatttttctttgctgtttttttggagtcggagtctcactctgtcgcctaggctggaatgcagtggcatgatcttggctcactgcaaccaccacctcccgggttcaagcaattctcctgcctcagcctgccaagctgggactacaggcgtgtgctaccacgcccagctaatatttttttttgtatttttagtaaagatggagtttcgccatgttggccaggctggtcttgaattcctcacctcaggtgatctgcccgccttggcctcccaaagtgctggcattacatatgtgagctaccacacccagccaaggttccaatttttctacacccttatcacacttttttttttttttaatagtagccatcctaatgggtgtgaggtggtatctcactgtggttttgacttgcatttccctaatggtcagtgatgttgagcatctttttatgtgctttttggccatttgtatgtctattcaagtccttgtcttttttttttttttttttttgaaacagtctcaccctgttacccaggctagagtacagtggcgtaatctcggctcactgcaacctctgcctcccgggttcaaacaaatctcctgcctcagtctcccaagtagctgggattacaagtgcatgccaccacacctggctaatttttatatttttagtagagacggggtttcaccatgttggccaggctggtctcgaactgctgacctcaggtgatccgcctgcctcagcctcccaaagtgctgggattacaggcctaagccacagtgcccggccccttgcccatttttgaactttttttctcattgagttttaggagttctctataattctattaatctcttattagagatatgatttgcaaatattttctcccattctgtggattgcctttttattctgtcgatgtgtctttttttttttttaagagatagggtcttgctctgtcacccaggctagagtgcagtagtgcaatcatagctcactgtaacctcaaactcctgggctcaagcaattctcctgcctcagcctcctgagtagctaggactacagacaccaccatgcccagctaccttttttttttttaaacttgtagagatggggtcttgctatattgtccaagctggtcttgaactcctggcctcaagcaatccccttatgtcagcctcctgaaatgctgggattacagacatgatccacggtgcctggcctgatagtgtgttttttaaaaaattttttctataaggaatggaggcagggttttactatgttgcccaggatggtcttgaactcctgggctcaagtgatccttccacctcggcctccaatagtgctgggactacaggagtgagccaccatgcccggccaatagtcttctgatgtgaaatttagtgcctttaattttcatgaagtccaatttatctatttttttctttttaatgttgatgactttggtgtcatatccaagaaactactaccaaatccaacgttgtgaagatattccctatatttaattttaagctcttacaatttcggtcaattttgagttaacttgtatatgacgtttggtaagggtccaacttcactcttggatatccagtttccaggcatcaaccatttgttgaaaagactgtcctttccatagcctgggcgatcctcttacctcagccttccaagtagctgggactactgcttttttcaaaaaaaaaaaaaaacttcgttttaaaactcttatcagtcctggataaaaatgttgcctaaggattctaagtcctttggccccacctgagacaaatgctgaatggaaccacttttcatgacctccactgctgcctctgaggtccacgtcatcgtcagtttttgcctgttctattgcagtggccaactgatctaaccaccccatcccttctccacacagcagccagaggtctctagaaccaggtcaggtcaggtctttggctacctgccacccagagaatcgcatacccagattcctgatcacagctcacagcacccgctctggtcaaaacatggtgtcaggtccctttgcctttgtgggtccctttctctgcctgacaggagttgagcctcttcacccaggtctgggctcagacactgaggccttccccacctccccgcccaaggtaagtgtccagcacaggtgcttgatagcagtgtttttttttaaacagtaggtttcatctgttaggttgtaaaatcagtttggtaggtcatggccgacagtttgttttcaactttttattttgaagtaattatagattcacaggaggttgcataggaggttgtctagggaggtcctgggtacccttgccccagcctcccccaatgttaacaccttatacactacagcacagcatcaggacgcagaaattgacattggtacagtctacagaacatactcagtttccccagttacatctgtactcctttgtgtacctaactctacacaattttaacttcatgtatagccctgtgtaaccaccagtcaggctgacagatggttttcaacaccacaggactccctcgtatgaaccaccccctcaccatccctaacctaaacccctggtaacctttaatctgttttccatctctataattacattatttcaccaatgttacataaatggaatcctgctacatgtatgttttcaagattggctgtttttgctctgaagaatttccttgagtttcatctgagttgctgtgtgtacagcagttactgaaaatggcactatatcacatacagtacggatacatattgttttgtatttcaacaataatatgctatatataacagtctatgccagataataatgtaaaatacttattattaatatggggttttatccaaaacatttatttttatttttaaaacatttatttagagatggggtcttgctctgttgcccaggctggagtgcagtggcacgatcatagctgactgcaacctcaaactcctatcctcaagtgattcttctgcctcagcctcccaagtagctgagattacaggtgtgagccaccacacttagcacctgtccaaaaagtttgaaagatattgctcttattacagtatttgttttcttcataccaccaccataaaataccaaactgcttcagaaattaccaccattttatttttatttattttgagacaggatattgctctgtcacccaggttgaagtgcagtggggcacaatcatggctcactgcagcctcaaactcctgggctcaaacaatcctcctatctcagcctccgaagtagctggaactacaaatgcacgccaccatgcatagctcatttattttttgtagagatggggtcttgttacgttgcccaggctggtctcgaactcctgggctcaagcaatcctcccacctcagcctcccaaagtgctgggataacagccgtgagccaccacatccagccaccgttttaaattcctatttattgatgtttaatgtctgtcttttacccaaactacaacagaaactctttgaagacaacttgtctgtttcaaaactgtggtcttataagcctcaaaccctgtccaacatgtggacactcagatgttgtgaagcaattgacatagaaacaaatgcaggaacatcctgtccagagagattatctgttgatgtggaacttgagtagtgaaggaggaggcaaaacatgatagtcacactacagaggcaggacttaatgcttcctaacagagcatgcagccgcacaatgcataccttgctaaacaagcaggtggcagggagcgtggctgcactgaggggaagcccctcatggactggggtgctggctggcatgccctggcttttgctgcactctccagctctgccccaggaacctgaaggcagctgctgcaatcccaggcatcacatgcaggctgcaaactcattttattattttatctttgagacaagagtctcactctgtcgcccaggctggagtacagtggcacgatctcagctcactgcaacctctgcctctggggttcaagcaattctcctgtctcagcttcccgagtagctgggatcacaggcacgtgccaccatgcccagttaatttttgtatttttaatagagatggggggtttcaaccatgttggccaggctggtctcaaactccagacctcaagtgatccacccaccttggcctcccaaagtgctgggattacagcagactgcaaattcagatgccccgtccctgtgtttaagagtaagaaaaaccttgtagatctctagcagtcttcctctcttccctcactgggtggaaatgctcattattaaaccagccacagccatgctggaggcaccctggttgccttagacacatcagtactcccctgatgatgggggaacgctggctcctctttagatgctcctgctcttgggatcccgtgagcacaacccccacccccacccccactgttcacagacacaggggctcttagggagcacaggagaaaacacactcaagcagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatatggtggatctagggttgaatgacctccccagggaacgcaggcttgaagtggaggctgagaatgcaatccgagtacagccataggccggtcaaaggtatggaggcggtgtgtagcaggggtgagcggggtaggagtggcttggatgtctgtagttctattctaagggtgcgggagacatgtaacatttaccttattcatttttcgagacagggtcttgctgtgtcacccaggcttagtgcagtggcgtggcgtgttcatggcttactgcaacctcaaactcctggactccgaacagctgggaccaaaagcatgcacagcctcaccaggctaatttttaattttttttttttttttttgtaaagatggggtcttgctaagttacccaggctagtttggcctcaagcgaccctctcactttggcctcccaaagtgctaggattataggcggagcgccagtgcctggctgggacgtttataaaaaggagcaatgcacaagaggcaacaaaggcaagtaaagaggaggctggtgggcttgcagaaacgccctgcagtacctatgctgcggttctcccacttcactgataacaaatcctcagtatccactgatacaaatcctgggactgctgggccagtcccaggaatgacactgggacagactccctggaggtggatcagaaagctgcagttttaccaggggtcctgctgttgaggcagccggctcaaggaccaagcccaaataagacactgagaggaaggctgcaggccagggtgcaggagtaatgaccaggatcagtgctccaactggccccactgtgtcattaaaaggctctgcaatggaatccatcctggtccaggcaggggagtgtgcctccagcaaaggaccaggcgtttcactgcatacacagcaggtgttgcttagtgaagacaaaaacccagagccagaggtactgtaacattcttcattatgcataaagtgacagtctgttagctgatgtgatcctgcaaatgaaggctgtctacccaccaagggtttctccctctgctagtaaaactgagactttgtcagtggaggctcaggtaagtccccacagtgctcatgccttccaaaaccacgcccatttccagtgatgatggtttgtgccacaggccaagtactgaacatcatgacactcatagacactcttcactgaagacgtggatagaccctggggccaccattctctcctctctggagtgttggaggggccctgaccagggcaggacccccatgtctggaagcagggttagccctggctcatgggggaccctgctgggcttagccattgccacctagggatcaggcagccttgtttcttcctactttctccaggagaagccccagagggacacttttctaatggtgagatggaacacggagcacctgccaacaggccttcagttatggtcagaggcccaaccaccagtctgtgttagtacctaatcaaacatttagatttaggctttagttattgcctgtttttacttgaaattcttggcttagaattattcccaatggggccaggcacagtggctcatgggaacaaatttaaaataatcagattagcatgtcaaaagatctcacgttatagaaagtgaagatctaagaccaaataaatactgataaaaaatacaggccagcagaagcttggatgatttaataaattaaaattgggagttggggagtagggaagaaggagaggaacatctctttagcatttgttcattctaacattcacatgtttgcttctccatggagttgtttcactatgaacaggttcactaaggagccagttatgtccatatgaaatgagaataaaagtgcaaactcattcagatcaggttcttctgagtggtgtttttgaaaaaaatatgtaaaataaaaatagaaacattctttgtcaaatacttaaattgcagccacagtagtgggacagccactacttatagaacacatgtctatttaaagcctttttttaggccaaagactgacacctatgcaattgatgtaggaaaagaaaggataaatgaagaaaaagaaagaacacttcatgttagacaatttagtcaccttcataggttttgacagaattagggatgcagaattgctcctgctgaggcagtgggagctcccctcaagctgaaagcgtgaagaggtgaggaggcagctatctacaggccctcagggacagctctttgtctttccccaaatcaagcatacaactacaaagtcctgctgctccacttccaagtcaaacttaataattcttaggtaactctaaataaatcttaagtaacagagtattctctgatgaggctcgtccctgtcagtgccagtaactaaaagccaagatgttgcaaatgattcttttattattttccaatcagccaacagtcctcacttagggctttcttccctttttacgcaatgactgtccttctccagagaaagcgacgaatctgcctccagcttcatcctaggtttgaagagaagatactattttcagaaactccctggaggtttacaataaatgccttactctatggactcacgtaccatccacattactcataagaaatatctcaggctggacacgatagctgacacctgtaatcccagcactttaggaggcctaggtgggaggatcacttgagcccaggagttcaagaccagcctgggcaacatagtgagatcccatctctaccaaaaatagctcagtgtggtatgtgcctatgatcccagctacttgggaggctgagacgggaggatggtttgagccagggccatagtgagctatgattgtgccactgctccagcctggatggcagagcaacagagcaagaccctgcctcaaaaaaaaaaaaaaaaaaaaaagtctgtaagttcatcacccaaaaacatttcaggtcacttttctgtacatgcttaaagaattgttttcccacttaattctgaaatctcatgccaataaacttcctgtctagtatactcccaaggctacagaactgaattctgtaaaaaagaattccatgatgtaggagggccagttttctaccagtggacattgttgtggtaagcagcttaatgtatttgcacacaactctgattttttttagagctcaaattcctgggtcaaagtgtgtacacacttttaatgcttttaacatatagagaccaaccagccctcagaaacattccactaagctatccttccatcagcagaaagagggattgttttttcccaaacctttgaaaactgcacatattttttttcacatgcttttattgctagtcagtctgaggcattatctcaacttttccctaggaagaagaggattctggaatgttcaacacacatccctgcacctggctccccactaactgtagcatgttatacctgcaatagagcactgtttagtatttatgtggtcacattcatgtaaatttgagtcacagctgcatttagtcttcctttgccgcacagccttccattcatcctggtgtcaatagctgtgtttggcttcttcctctattcaatcacagcctgcattgcatggagttcatctgttttgacaaacctgtgtctcctgggccttcgccctgccgtacctggactggcctttctctaggtgccgtacatgttagtgggggctccttatttcctggattctatgactttcttatttctaccttattccttcattttagtgaggaacacctcctaggagcttcctgagaaaagatgcatgaggattatcttcttgtgagttccttttttctaatctcatatttcattgataggctggttggtatgttagtctgctagggctgccatataaaatgccaaagatagggtggctcaaacaacagaaatttattcttcatagttttggaggctagaagtgcaggatcaaggtgtcagcaggtttggtttcctctgacacccttttccttggcttgcagatggctgccttcttgctgtgtcctcacatggcccttcctatgtccaaatttcctcttcttaaaaggacaccagattgaattatggccaactctaatggtcttattttaacttaattgcttctttaaatggccctatctgagttactgggggttagggcttcaacacagaaacactggagggacacaatccagctcataagagttggtacagaattttaggttggaaaaaatttcccctcagaattttgagtatattgctccactatcttctagtttcctctgtgtcctgctaagatgatgtccctttttttgggagacagggacttactgttacccaggctggagtgcagtggtgtgatctcagctcacagcagcctccacctcccaggctcaagtgatgctcccaactcagcattaaagtagctgggactataggtgcgtgccaccatgcttggctaatttttaaaattttctgtagagacagggtctccctatattgcccaggctggtctcaaactcctgggctcagatgatcttcccgcatcagcctcccaaagtgttgggattacaggtgtgagccatggcgcttggctgatgatgtccttaatgcatggtgatacctctgttctctctctagaagctttaggatctttctttgcctcaaagtggggctattttcattcattttgctggaactcagtgagcccttcaaatctgcaaaattgtgcccatctttggggaaactatttccctgatgatttctgctcctttggtttctgtggctgttcttcccacaaatcctctattatttagatgctggaatggaaagctttctgactgtggccttcacttcagagatagtagtctagagacctactggagtcgagcctccagccttctgggatgggggagggagggtaatgcagctctaactgcttagtaacagaattctgtctttagtccctcatttctagaggtgccttttgagaattccacaatctacacagaactgcttctaggctttctatggtctactaaggtacctggggcttccaaagccttgtagttgcctcctcttccactgtctttcttacctcatgacctttagccacagccttagtggggctgcaggatggaatagagctaaatatgtcttcaatcccatctttaaacatatacttcttaaatacatatttatggtcaaacaggcctgctgtgcccactggcctcccctgccttctgtaaatttgcaacagtcaggtcacagtcagcctgggggacgtcccatgctaaggtcttaggtcggagtcaggcactggcttttagtgagaaaggcagcctgtagctggtgaagcctggatggtgcctgaaggaggagctggagggtgaggtctgactggccactatgtttgctcctctgagcctgaaaggtcccaatgcccaatgctgtttcaacttgaacattgagcccagaagtggttgtgagtaggaccaggtgtgcaaacttcacagtggtctctgtccccaaccaccccaagtgctagagaaaagagttcagtaattgggatggctcccatgtagcagctggtcctgaatgggtggctcagtacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccaccctgctcagctagaaggtgctgcctatatttgaagttcaaggtctctgttggaagacgaagcccacccagggcacacagttctgtgataacagagcctggagtcggctctagagcaagacagagctcctgacccccatgctgcaagtcttctgtttcatacaccctacaccagctctacagaaaaaaacaggacaccagggagcagagggaccctaggaaagggaaaacatgacagacaccctcatgtggtttggctgcgtccccacccaaatctcatcttgaattaccacgtgttgtgggagggaccaggtgggaggtaactgagtcggtgggaggtaactgagtcatgagggcgggtcttttccgtgctgttatcatgatagtgaataagtctcatgagatctgatggttttataagtaggtgtttccctgcaccagctttttctctgcctgctaccatccatgtaagatgtgacttgccccctgccatgattgtgaggcctccccagccatgtgaactgtaagtccattaaacctctttcttttgtaaattgcccagtctcgggtacatctttaccagcagcttggaaacagactaatgcacacccctactcagaatgccaagaacttcagtcatcactagcaaataaatctcctcattaccaaccaaggaaatacaaggaaatacactcacctcttcaacctttttgacaaggggacgtgaatttctgatgaaagttatcttaccaagtttaaattcataattgggaattcctctgtaagaagagacagagacagagaaatgttatttccaggaaaaaaggactaaaattcatttttgacagtcaagaggaacgcagaaaagatgctgctgcaccccacctgggccctttggtgcttcctggcatcctcccaggagggaagcagaaagtaactgacttcttggtttggtatcaatattgggtatagggccaggggctttaggctctgtacctgtctatggagaggggtcatctgaaggattgggaagccctcactgtcactgtcctgagcttcacagaaccccctgaggtggctagactctcactccagtattctgatttcacacacacaacagacaactgacacacctcagccctgcccctgccatcatggccaccagaggaagggtctgctgtgggtccccggacccagcaacagaagcacatctgaggtagctcctcagggaactttcaggggaactgagataatgtgacctgattaataattccaagtcacaaaacaggaaaataggcagatcaccaaatagggaccagaaaggttttgagtaagagacagatctaatcagactcgcatcttaggaaagccagtgggggcaagaagaggctgaattgggggtatggagaggtatggagagaggctggaccacagtggtactgggggtggcactgtggaaggaggggcatgttgtgctccaccccaccaaggagagcagctaagggttttagtcccttgggagactactgacccaggctttgtctccagaactggggtgaggctgcccgaccccagcgggctggcacagatcctcctcctgtcctggaggagagccaggacagacctaccttttaatatctccaggcttgattggggaggggctgggctctacccctttcttctttccatccagtctattgccagatccagagaaagcctagacaggaagtaggtgagtcatataataagcccaagtgtgaggacgatatgtcctttgcttggagatcactgcagggatgtgagctgggggtgctgtgcagaccccttcaggactgaagccctgactcctcaactgctggggtgctggcagctaagaactctgcccagttcctcagggggtggccatgagctgaagacagccacttggccaagggcagccagcagtcagtgttgggttaaaagacctgatccctgcctctgcagggccacccagttcaagctctatgggtgggctaaggctactgttgtgactgccccatagctcagcttcccatcattctgccctctctgctgcttcctggcacctcctgccacctcagtgcccacacatgaaccacctccacctgtttcccatggagccttgccagtagttatgctaagggtcatgtttgcaacctacatggtacaggcaaagaaaaaaggaaacatgatttacaagagagagaaagcaaatgtggtaacttttggtgaacctaagggaacagtatatgtctactgtactatttaaactcttcggtaggttagaaattcttaaaaatctgggctgccttatggggctgttgggaagattccaggagagagtggatacaaaagggtttggtaactgagcgagtggcagatttgcatatgcacaggtacccagaggcctaacccctgctgatgtccatcgagcatcatggagaacaccttgagtgagtgctctaatttcaaggagcagagggcacagcaatataagtcaagtggtctggtactcacgcggaagcccagctctccagcatagccactgtggtcggcttcaccttcctgacagggaaaaagaaaaacaggtgagctcctcagcggggacacccagcttccctctcacccccacccccggctaggatgtcccccggaagcatggctggaagggacgcagaggatatgactacaccaacactagcagaggccacccacgagccactgccaggaactcaaaagcagcatgcagcaggacagcaaaggacactgaggataacacttactgtcgactcctcatgctggacttgtctttcgggttctttgtagcccaggggagcatcaaagtccacctgtgtttccaggattttaaaagtaaaatattgagacatgaccacccttggcttccttttttgtttttaattgagacaactgtagattcacatgcagttttaagaaataatacaaaagatgccttgtacacttgcccagttttcccaacggtagcatcttacaaaattacagtaaagtattgctgccaggatatcaacactggcacaacccactgctcttattcagatttccccagttttacatgtttttgttcatgggtatctttagttctacacaatgtaatcactgtgtggggcatgtatccaccacagttgagatgtagaacagtttcaccaccactaggactgcccatgttgtctttttataaccatacccagctgtctcccagccccctccaccagtcctaagccctggcaaccactggtctgtcttccatttcgaaagttctgtcactttgaggatgttatataacgaagtaactttttgggattggctttttttgctcagcagtattccctagtaatacaaccaggatgctgtgtgcatcagcacttcattcctactcagaaggttcagtacgcttccttagctcttaagcatattcactcctcggccaggcgcggtggcccacacctgtaatctcagcactttgggaggccgaggcgggtggattacctgaggtcaggagtttgagaccagcttggccaacatggtaaaaccctgtctctaccaaaatacaaaactagccgggcctggtggcacatgcctgtaatcccagctactcgggaggctgaggcaggagaatcgcttgaacctgggaggtggaggttgtagtgagccaagatcgcaccactgcactccagcctgggcaacaggagtgaaactaagtctcaaaaaaaaaaagaatattcactcctcaacgggtcagagctaaccatggcagcactggcagcaaactctgttgccccaactggccctgagatagatcacaaggtcacagtctcctcatgatgttctgacagcatcttcctcctctttacccagagtcccaggggctgtttgatgccctcctgacaccctggcctgcagtggtcaccaactgcccatcctcccagggcccaggctcactgtaactggacagagccactcacgttcatgtcacactcaatgatggacactgccttgtcgggtttggtctccatcacacgcagttcgtagatctgtggggcaaacacagaaatcagttggatggtttcctggcagcactggagctgtcgctgtccatgttactgtggctctactggctcctgcgaatgacacagcattcatgcccatgacacaacctacagctgcacttcttgctgtgacaacactgccataagggacaggctgccctgtgcccatcgctgaagagatgctgttccccagatatggttcaaattagacaaggtagttatacagctaactgcaaaagacactaacaacctttaacctggaaagttcacttctggaactttactatttattttatttatttatttttagacagaatctcgctctatcgcccaggctggagtgcagtggtgcgatcttggctcactgcaacctccgcctccagggttcaagcacttctcctgcctcagcctccctagtagctgggactataggcatgtgccactacacctggctaatttttgtattgttgtagagatggggtttcaccatgttggccaggctggtctcgaactcctgacctcaggtgatccgcccacctcggccacacaaagaactgggattacagacataagccaccgcactcggccttcgaaatttattctaagtaaataactagctatacccaatgagaaaattctaagaatgctcataccaacgtcactaataccactgtacagatgctccttgacttatgatggaaccaagtcccataaacttataagttaaaaatgtattaatattcctaacctaccaaacatcatagtgcagcctgccttaaccattctcagaacacatacattagcctacagttgggcaaaatcatctactataaagcttattttataataaaatgttgaataactcatgtaatttattgaatactgtactgaagatcaaaaacagaatggttgtataggtattcaaagtatggtttttactgaatgtgtatcatgtttgcatcataataaagttgaaaaattctaggtagaaccatggtcagggactgtctgtatactcaaaatgcagctgaattatatttcttcatatgtaaatttacagttatacaatggtatgctacgcagccaacaggaaaataattgtaaaaccagtcatgttgcttgtgtctaagatgacctcacctatgtaaaaaaggcacataaaaaatgtccagaagcagggccgtgcgtggtggctcacgcctgtaatcccagcactttgggaggccgaggagggcagatcacgaggtcaggcaaatgagaccatccttgctaacatggtgaagacccgtctctactaaaaaatacaaaaaattagctgggagtggtggcaggtgcctgtagtcccagctattcgggaggctgaggcaggagaatggtgtgaacccaggaggtggagcttgcagtaagctgagatcgggccactgcactccagcctgggcaacagagcgagactctgtgtcaaaaacaaacaaacaaacaagcaaacaaacaaactccagaagcatagaaattaaaagtggccctatctactttttcctgcatcatttcaggttctttgcttttatctaaagtctgtcttgcttttttttttttttttttttcgagatggaggctcgctctggcacccaagctggagtgcaatggtatggtcttggctcactgcaacctccgcctcccgggttccagcgattctcttgcctcagcctcccaagtaactgggactacaggtgcgtgccaccacacccagctaatttttgtgtttttagtagagatggtgtttcactatgttggccaggctggtcttgaactcctgacgttgtgatccacccgcctcagcctcccaaagtgctgggattacaggcatgggccaccatgcccggccagtatgtcttgcttttacaaccattttaaaaagtctggatagtcccaccatttaaaaaaaaaacctaagcagggccaaatctacttttaaaagtgtcataattattgaatagataaggaataaaaaaaggatctgtcattgtgtggatatactaccacttatccactgagcatccggcctgtttccaatcattttgctgtgttaatgacactactataaacattcaaacatgtctcctagggcttggctcatgcttctctaccgttttcatgttttcaaaaggccacaaataatcagtgggtcataaaaccaacagggctgcaagcagaactgaaaaggaaagaattggaagacagtaccctagaagtactattgcatttagtaaggataaatattcctgtgacattttccatttacttttatgtattggcataatattaaatactttttttttaaactatgggaccaattttctaggttggtgctcctcaaactacctgggaagacctagtttttaaaaatgtgcagtctgctggactgccatgtggtcctcctgcacagaagcaagacacaacacacaccagacgcccagagctcaccaagacaagtactggttctgtggccatgtgtgtggaggttatgacaatgccaaattactatacgtttctaaacattcacttttgattcctgcttcctcgaggccctggcaaccaccattctttttttttttttttttcccttgaggcagggtcttgctcagtcccccaggctggagtgcagtgccttgaccctggctcactgcagactcaactgatcctcccgcctcagcctcctgaatagctgtaactaggcacatgccactacgcccagctaattttaaaattttttcattaattttttgtagtgacaggatcacactatgttacccaggctactctcaaactcctgggctcaaacaatcctccaaccttggcctcccaaagtgctgggatgccaggtgtgaaccacggtgtccaggtgattctactttctgtctcccatgagtttgactactctaagtactcatgtaagcggaatgtagtatttgtctgtctgcatctggtttatttcactgagcagaatgttcatccatgtggtagcatgtgtcagaattcccttcctttttaatgttgaataatattacattgtatgtgtgtaccacatattatttacccattcatctgcaatttatttttgactatggtatgagttaggaactcaatttgttttttcatcttaggaatagtcaatatcccagattccgcaaccccagtatctcctttgcctggtgacatcaatgctgcctcagtggtggaccaagattctttgtatataaagctttcttccactggcctacttgtctactccagaaccaatgccatatggtgtcttaactactggagctttattacactcagctgccgtatagaatcttccttatatatgaccagattcttttgtcaatattttatctacaatctatgtatctgtatcaagtgacaatgatctgtagtttacctttctcctatccttgtgtggttttggtgatcaaggttatgccgacctcagagaatgagttgggggatatgttctttctctatttttagaatatctaagagcaatttattgcttgagtgtgaggaagaacttgcatatataaccatctgggcctgtgtttcctggattaagatttttctgattgaattacttgactggctatacaattatttaggctgtttgtttttttttttctttagtcaaacttcaattacacttttctctaggaaataatttatcaatgtcaaataagttggctcatttcttagtataaaatttttcacagttttatctttcaagatatttgctttatctaattcattttatttgtttttaaacattcaatatgcatgtagacttttcagggtttgctttttttttgtttgaggcaaggtcttgctttatcacctaggctagagtgcagtggcacggtcactgttcactgcaacttctgcctcccggactcaagtgatcctcccacttcagcctcccaggtagctgggactacaggtgcatgccaccatgcccagctaatttttgtattttttgtcgagatggggttttgccatgttgcccagtctggtctcaaactcctggacttaagtgatccacccacctcagcctcccaaattgctgggattacaggtgtgagctaccacacccagcttcagctatcttttttattaactttattgaattgtaaacagagaacactttaattctaaacaactctctcaagagagtaagtctaggccaggcgcggtggctcacatctataatcccagcactttgggaggctgaggctgatggctcacctgaggtcaggagttcgagaccagcctggccaacatggtgaaacctcgtctctactaaaaatacaaaagtagccgcaagtggtggcacatgcctgtagtcccagctactcaggtggctgagatgagacaggagaattgctcgaacccaggaggtggtagctgcagtgagccaagatcgcgccactgcactccagccagggtgagacaaagagagactctctcaaaaaaaaagagagtaagtctaaagacttactcttttccaacattttagatgtcattttttaagcttcatacattaaacattattactgctttatatggcaacatttaccctggattcatatttgccaatttatttattccctattccttcttgctttccttctaggataatgcttattcctaaagtacatgcttttaaaattccattggtaaataacctctctcagatttggttcatctgaaaatattttcactttgcccttattctttaaggaaggttttgatgatagttacttgatactggctgtaactgttgctattcaaagacctgctacttgctgttcttctgaaggtactgtgttttctccctgcttacctctctgtatttggtattttctacctgtagcttattctgtttgttatacattataaatttcctgtcatgatgggctgaccaccaattctaaatcaatttcagttaccatctcttcagattattgcaattcctccattctttcctactgggattgcaatgggcatgtttgactttctcagtgtcttcaacatctcaagctctcatatgttccatccccttgctcctctgtgtgaaattctgttatttcttcagattcatctttcattaactcttttatagctgttgtttaacattgtttttcaaatctttctggttatttttgatagccttttgttgctcgctattataattccattttaaaaaatatctttgaacattttatatctaattattttacatttgtatctagaaattctaatgctgatttccttagggatctaatttttattgtctctgctttggtgtagtttaattatgtgttctttgcttgttcaattgacagcaatcccaaagacgtaactaaactggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtattactaccttaacattaaaaacaataacattaaactgcctgtaattaattataaaagcttagagtattcagttaaggtaaacgatacctaaaatgttctccacaaagctaaagggaacaagattatttcttagtttattaaaaggaaaaaagaaagtgtgattcgaaacccaaggaactgaaaaataaggtcagatgcctcaaatatgaggaaactgccagagaataagctggatccctgcactgacaccaagggagtaactggctaaaccacaggcagctgtgacacagctgtgacggcccagtccccgaagggaccagagagtgctgtgaaggagctaagtgctagcttcagggaaagcccagccaagccaggctgtggtcactcccgaacactaaggctagccctggcaacagctctgtgggagggtcaattgtcaacagtcacagtgaacaggggcacccatattactgtgctccatgcctgtggtgggacagcctgatggcaggattgccaactattacatcctcctgcaggcatattcccataggtaataggaaagtgaatgctttcttgaattttggactaagtcctgtcatttcactttacagttaaattgtctagatccagacacctaaacagcataaaatcagggatgaaaacagaggcattcagacctgagagacttgtgtcagaaaggtcaagcctagagaagctgctaagtgaaaacggaagctgaagaaaacaggaggtggaggaggatgtgggctcccaggaggagaggtgagcctaggaggtgttgccctaaggcagagccaggctttgcttctcagatgccacacagcacttggccccactgaagggcctgtcagcttctgtggggcaggtatcccaaggacaaggacccagcagggttgttattgtgtctccacagccctgcaaagggcttagctcagattagaggtgcagtggggacctttcaaaccaagacagaaccagcagccttgccaccaaggtacacagaggtatgactaataagtctatcaatgttcccctgtaaatgcaatctatcctcaaaacagagttaccaaatgaattagggctctaaatatgaacccgggaaaacttaataaccaaacagtaggcagtaattaggtgataagatccaggcatacgctgcttaaaaagaagccccattcaaacattagaatggacactgcaggtggctcttgtcaggaatgacctgcatgaactgggctcaccttttcattatagttgatggcaatcacatccccggtggtcagacaggcaaagttcctaagtgcgttttctaatctgcagacacattctgtcaaggcaacatggcaagatggataccttaatctgaaacaagtttccatgttagatgattactggtaggtagagactgtaccatgatggtacttgaaacacgaagcttttaatacaataaagtactacttggcaataaagaaggatggaactcctaatatgcaataatatggatgaaatgccaagctggggtaacaaatgccaagctgggggaaggggaaataaccaaccacaaaagggcagtgagattccatccacatggaaccctgagaaagacagatctatgaggatgggaggtagctgagaggtttctgggccaggggatcaggtggggactgacaggaaaggaccttttggggacatggaaatgttctgattacatgggtgtatacattttcaaactggctgaactgtgtgcattttattgtatacaaattataccatgggattttaaaaaatcctgtgggagtactaaagaacaaaaaagatttaatgagtcagataggtcctctcaaaagttcctcaaaatcaaagatgctttcatttatacttctgttgtttctatcttttgagctgataactttagttaatagaaattaaaataaagaaaccagcaaatactttttataacagtaaaactgtagaacccaaatgcccacacaaggaaatgtctattcatgtggaatattttgccatgtcttcctcatcaatttgctgaaggactttacataaaaaggtcacatgaaatgtggctccagagcctgccactgtgagtccaacttgagggtgaaagggtgaggctatctaggttcacctcgcttggtcaaacagctttccagaaccagagcaactttgtgaaaagcgccttatgtggtggatgctttctttgctcccaaatatgaagtgccacggtacgaagtgcccttccctccactcctctagtgaccctgccagggcatcttctctgacttccactgcagcagctggaggagcagagccagagccctcaggctgagaacacgaggcctctgcaggcagggcgggctccccatatggcctctgcgtactctggcacctgctgcagcaccagcttcccactttctctgctcggtgccaagactgctttcatccagacctcagccagaccagaaaacaccaggctctcaactgatggaagtgacgccctttctccacacactaacaagttaattgtgctgacaaaacagcatctgagatcaacctgataagtctgcattggggcagggcgcggtggctcatgcacgtaatcccagcactttgggaggctgaggcaggtggagcacctgaggtcaggagttcgagaccagcttaggcaacatggtgaaactccgtctctactaaaaatacaaaaattagccgggtgtggtggtgcacacctgtaatcccagctactcaggaggctgaggcaggagaatcacttgaatctgggaggcagagtttgcagtgagctgagaccgtgccactgcactccaacctgagcagcagagtgagactccgtctcaaaaaaaagtctgcattgcaacacatgtaaaaaccctgagaaaatgggcatggcccattcctggtcactgacagccaaacaagcatgtctaggtcagagctctgaaggacaagttaactagctcttcccataggacatccccctgcctgtgggacaggaggctcaacaaggccatcgtgtccagaacataggcagcaaagaatatacatggcccatatgcatccagagcacacccagcagtgccttgctcctaagaaaacatgcggagagagcgctactgggaaaggaggcagcttttcttaacttcctatctgtctgtgttgtttgactgtttgttttttttttcaagtatgcattaaaaaaaaataaaaaaaaagaagtagaatggagtggccactcttatgccatgatcgtaacaggaaaaatcagggccatggagctagagatcttgattggtgcacacagcaccgtcccgtacctgcactgcctacttcctgatgctgtcaacacatacacctggcttaagttcagaggtgaacaaaaagaatccactagaacctgatacctttgctttctgcttggtgacatagaaactgcagtcattgctacctattggcctggagtgaatcagctctcaggctggcatgcagtgaggttgacgggccagtgcacagctgggcggaggtactagggagccacagaaggggctggagctgaaggcagataagctgctccctccttccactggacatactgtgcatcctggctttgtgccaggtgacacagaccaactgaaagaagggcttcattgtggtctccatgaagtgtctggaaagtgacagaggtggcccagacagcacccagtgcacttggccagggccacgcagatgtgctagctgaaccccattattctcaaatcacaacttgaatcacaaatgtgtgatccccaaagcaggcacagattcaatacagtacatgatgtttaacaaccgccagcacactctcctttgtctagaagaactccgcttatttgaaaaagatacacggctttggggttggtgatgtccaggaagtcagggctctgaggttggaatttggagtaggtggccacttgaaggttgacgctctccacctggaccaggccgccttcttccaagagtaagttctgcatcatctgaaaggaagaagaggctacatgagactcctagagatgaagcagcctccacaaccactgctccctatacactgggcaggcccgtcttacttgggtccttggaagaggaacctgagccaagataagtaattcgtgatactatgtcaggaaggagggaaaaatcaagtgatgtggaaggaagaaggccaataaaggggtgctactgaagctgtatagctcacagtgtgaacgcatctctgcagggctgcccggattactcactagctccaggcttcccaggggcagagcattttcctggaatagtcactcactgtacttccaagctgtcccacaagcaaattataaggccctgcgtcaagtagggctgcacctgaggtaggacaaaagcagcacaaggcaaggctgacctggcaatggaatggcccaccacagctgaggctgcaagatggtgacagaccccagaggtctctgctaaggaggttataaaaatctgacaaagcctccacatgtctctattaaacaacccagccaggtagacgacggctgagaagtgagacggaaagagataaacaatgcccatgagtactgggtgtgcagggagtccagactcaggtcagaagctctatgtctcttgcaatgaaattttgcttgtcttatttgaaaccgtcttaaaaggggtgtcagacatatacatcagtagaaagagccgtagaagagagctcccacgcaccgagccctgacagttggacagtgctcacgtcgtggctcagtccatcgatcagcactacctcacacccagtcccaagccacattagatgccctgaagcaaatcccaggtatcacatcccttcaagaatgtttcatcgggagtggcagtgagaaggtgactttaacagccaagggaaaagggggctgagggctgtgtcacaaatgagagggagctcatgaggagggagaggcatgctgaggccgaggctgtgcctgggaagccgtgcctaggccatgagtgaagcctgagtggtgggccctatggataggcttgcagaggaccccatgcactcacgctgacagctgcttgtcaggctagtaagggcagaaatagagggtggtcactctaccaaatgccacaggcaggcacagaaggatgcagaggtgactggctttggtaacgggggtctggcatccccaggagtgatgttctaacaggaagtattctaaggctcagagttagccagtcgcaggccaggcgcactgtccctgggtagatttttgtgggaaatttgtcagcgaggggaaggatactgggctgcaattgcaagcctgagggaaggctggccagggatggggggtggcttcctcagccagaggcaggacactgccataggtgatgtgaggaggacaggcagagaggtcagactagggcttgaggtgagaaatgggctgctggaagaggcctgagagcactaagcaggcaggaggagctgatgcctggccctccccatgcagcattttagagcatacagcacaacgggcagccgagtacccacatgtcacaaacggctagtccagggctcggatctaggtcagcagacgaagccttggctacaaggaaaaaggccagtacctattccaggctggctcgccctgaagaagcttgggagcatgggtgggatggagtccaccagccagcccagaaaaagcactggctcacatgccctccaagacagcagatggggtatacctgtcacccgcctgcccatgccaggagctggaaggccagctcaggggaagaggtggcctgatggcttcacaccccaaaccagctccaggctacctaaagaggctttccaggggagaaagggttcaattagtttcctggtctaaagcagtccaacagcttggacaagaggccacccaaacttcaagtctatgggttaaaggagaaccttcgagatacagtgtatccccagcatcaccacctcctcttataggtgagccacagaagggactggggaagtagtcactgcctgacacttcagctacctagagtggcttcagtgaccaggtgttctaccggatgagcacaatgtggcctcaggcccttgggggcacctgcagacaaacacaagaatagcaaggggctgagcagcaaatactggggagggcaggtgagccaatctgggctttgaggcataaaagccccccaacaggccaggttgggcaggcctagtcagctgaggtgaggaggcagcatgggaaggccaggcactaggaggtgcaatgggagtgcagggctcttgtcggggagacactggccaggcccagaccttgggaaggaccctgggacccaggctgaagaggatgccactaccatggcagcatgggcaaggtcacctgctacagcaggaaagagaccttcagaattttgattcatattattgttgttttttttttttgagatggagtctcgctctgtcgcccaggctggaatgcaatggcatgatctcggctcactgcaacctaagcctcctgggtttaagccattctcttgcctcggtctcccaagtagctaggactacaggcacgtgccaccacacccggctagtctttgtatttttagtagagacggggtttcaccatgttggccaggctagtctcgaactcctgacctcaagtgatctgcccactttggccttccgaagtgctgggattagaggcgtgagccaccgtacctggccagaatttcaattcatatttaatctcagaaaatattagttaaggccatcccttctgaacgtctggcggccaccatgatagggcatcagcaggagaggtgggctgtgcttcagaccacctccctggtggcagccaagcaagcactcctgagagtttccagcccacagctcactgcggggtctctcagtatgcctgatgtaatccaagcacaaagagaaggacaagcaggtccctttgtgaacttccctaatgtgccagagctggggagaggagtgaggagaagaaggagccaagtgggccacagctacctgtgtggaactctcactgctgcaggctcctccctacagcactggcacagttctgctcacttctctgaggggtacagccttgagggcaggctctggtggctcacacgccctggatatcccagcccagatctgcaatgacatccttcaagtcaactttccaaagagagcctgcttgtaaggaaaaagacgtcactcccatggcagctcagttgagagatttgggagactacgtcagaggtaactgaaaacatgtatgctgtgacagactactaaaagtaggggaaaagcataaaaacctcaaacaccctacttactagaccacctaaaaaatactgttgctccattatttttaaaaacgcctcacccaggaaatcacagatgaacagttcagctgcgcaactatcaaagaaaaggccactcccacagcacagtggcccacaggtgcgtccagagcccaccagcccgcataaggcacagtgcactgctctggatcccttctctctcgctgggtcggctcaggctaagacgctgagcaggaggagtaggcggggccacctgctccagggccaggactctcgagtgcaggagatgtctctgcctaagtggctgctctctagagaccctggcagccccactcacccagtgtgggaggtagcagatgccctcatcagccacaaactccagcacgccacaatgcgtcatgcggtccgaattcttattggtcagtttgaacagcatgggataggtaatgttaagtcggcctgaaaataagagagagactatgaggcacagctcctatgaagggacacctgttcggcccacgccttcccatagaaggagcctccccacaatcctgccctcaaccccacactcctctggcagatgaatccccctctgtgagagcacagtgcacggctcaaggaggaacctggcaacttggtaacacagcactggcatagacttgtgattttctgaagtcaacattttaaaaagtgatgtgttcattcatttattcataaataatttcagtgcccaccatgccctggacaaaatcccgaccttcaaaggtttctagtttgaaggtagaaaccttccaacaaagaaaaccacaaccagatgctgcaggtgctgtgggaagagctggcaggagggggcagagctactgggctaggctcctagaggccgagttctttaggctgggcactgggcgggcagacctgggaggaaatccaggcagaggtggcagcctgagcaaaggcgtggaagggaagaggagcccaggcagttcagaaatggtggataattaggcaagacaggctggggacaggtgtgcgagtggttgggaaggggaggggcaccacacggggtagaacctagggcctgggcccagcgggcagtgtgagctctcagcagggtcatgacataggacgccccctctctctgatggaccttgaggtgtgggctgaaagcaaggccagaggcaagtaagctggactggtgacgtgctgacccaagaggtgcacaggcacataaaggaagggctggcaaaaagaggcaggaaaacccaggagacactgggcccccgggagaagaccgagaaggaactgatggtagtgatggtgtttgccatgtgtaaggcccttgttcagtcttcccagaacagtcaggtaggtactatcattatccccttttatctatggggaaactaaggcccacaggttaagtaacagcacacaagtggtgagcacacaagacctcacagcacacaagtggtgatgccaggattcaaaccaaggctgctggcttaagtccagggattcaaccatcaaagcagaatttagcttgttagttcagacaaatattccaataaaaatcacacttagtgttaggaagtaacgcagattccatttgagatctccctaaaaattctaataaagcaaatcaagttaaaagcttgggcaggaagctacagagaacctctgagagtagcatggaggtacagtaagggtgggcactccctcctatcaccaagggtgactctcacactggcagtaaaggggccaggacctctgtcccggtccacctctcagctgcacagccatggagctgacatacagctggtccacagtaaactggactgggctcagccaagggtctgagattgttgcaagtgaaagagactccaatgtccctcagtccactgactctcaaactgcattttgtgacttagaggctcccagtgccctggggctcccagtccctctgtaccccctcactttctccaaaaaaagcagagaacctcattttatgaattagaggacttcctataagatttagacagaaagagtttctcccatcacttaaaagatttgaacaacactgatctgagctacacctcaatgacccagcccctgagtctcttctggacacctgtgccaagggtcacccctggtgtctggctcctgggtcagcatgacttgaaaggaagacctttttagggagcctgttctctcctctgtaatgacagggtcttcgtgagaactgtgaactccatagctctgttgacctactggttgagctgaggcctccactgggtatagccacagccagtgctggctcaggggctacctccaccttgtggttggaatcggatagcttaggttgtcacagacactacagtacttctgatgcacagacactgtagatatccccaattaaagaagaggacattgaggttcagagaggtcaagttgctactctggagtcaggctgggcaaagagcccgaggtgagtcacaccacagccagcacctgttctctgcttgctgccaccagaggcccccaaaaccaagcatgaacctgtcctcctggccaaccccagtctcctgcctcacacaggaagaattcacaccagaaacactctttaagtctggaaggcaatgactgcatccttgattgggttgtccatgatagggattttctgtgcctgtgtagtatggggctagggcatgggtttccaggttgctctcatgggataaggggtcagagaaaagggaggaagaatgtggccactcttagaacccctgtgggcctatctcactcctggtaagaggcaggagcccagcaagaggagtggcttctggatggaagacaatagctcagtttttgacatgctgaggatgcattggtgcactggagattagaaacgggggtctgggccgggcatggtggttcacgcctataatcccataactttgggaggccgaggcaggcaggtcacctgaggtcaggagttcaagaccagcctgcccaacatggcggaaccccatctctactaaaaatacaaaaaattagccgggcgtggtggcgggtgcctgtaatcccagctactcgggaggctgaggcaggaggatcacttgaacctgggaggcagaggttgcagtgagccaagattgcgccactgcactccagcctgggcgctaagagcaaaactctgtctcaaaaaataaataaataaataaataaaagaaaagaaatgggggtctggagctcaggaaagatgtttggtgaggggatgaggaacctgctcacagcgccctcttgtgagctgaccaattcttcctttaggaaaaaaatctagtgagcccagccaatggcatcagctgccctggcacggtacaaagcacttgatacttgtaccttcacttaatcctgacagaatactgagaacagttggggggtgggtggaggtggtgatcaggaagggaaagggaacccccttcacagaggaggaacctgaagcacccagggcagtgatgaagctgaggttcagggggccctggcctcgccctaggtacctgtgacccaggttctcccagcccagcgcatgccctccacggacaattcacaaccagatgctgacaaagggcactggtgtctggatgtactgaggagcccatgctgactcttggtgtccatatgtacattatctaagtccttaagtcactcagaagatacttactgagttggtccagggccgagggtggcataattactgtggaaagaacatttaagaaatattaaaaaataaaaataaaaaggacagaccaaaggcaagatgcagtttctttatatctaacaaaaagccttaaactgtttttagggtagccagaatgtcccagtgatctttcatgaagaatcttacttgatgtaatttattttgggaactgaatggttatcagccataaacctaaccataattagcaccccaccccaacagagcaagtcagggataaatcccagcaccattttcacagtaacactagcttctgactcccacatgcaaagtaagtactgttgaaggctacagcattgcagacttagggcaggaaaagttactattcaaataaaaacaagcacatactcttccctcctttctccacatctgacctgtcattaggccctgctagcatggacacagagaagcagcggtactgtgtggagaagcggttttggaagaccctgggaatagggtggtcgaacatgttgaaagagaactagaaggaggaaagagaaacaagtattaaaacaaaggtacatttcttcatgtcaaaagccaaaacatgtcagagtaattaatgctactaaacattgtcagagaacacaatgtactgaaatcttcaatgtaatcttactaaatacaaaacaggccatgccaagcctgtcctgaacctttttcagggctatgctcccatcttcatcctcaggatcaaggcccaacctcttgcatacctcagagacttgtactgacagccccacagactcctgcctgggctagttcctctgccttgaacacttttcctattatcattaatctaaacaatatttgttaattgaaacatctctttattgagtgcctactgtctgccaggctctgatatgagcacaagggaagcaccactccagtgatgtctgtccactaacaaaatagataccacccctgtcctggtgaaaatgacactcaaagcaagagagatatacactccaagcaacggacacacacacatgtgtgtctggcagttctgaagacaagcagcagggtaagtagacacagggctcctgggaatgctattttaaataggtggttaggaagggactctgcacaaagacctgaatgctatgagagggagccaggcaaaaaagagggaaagacattccaggcagcaggaagaacaggtacccagtggttgcaccccttcccctgggttccaattaccatcctttcctttccccaggaagcctctcttgctctgctgagggtcaggtctagtgcctctccagcgtgctctcacagcacaaagtaggtacacgttacactatgttatgatgctttcttacagcaacaagcaaagctaaaacatgatgccattaaaaagataagatcctagatcttaaactgtagactaagatgaggcttagcaaacatgtatcaatttgaaggttttctcaaagtacagtattcctcccaccccccacccccatatccacaggggatacattccaacatccccagtggacgcctgaaaccacagataatactgaaatctatacatactatgttttttcttatacatatctacaattttcttatacatatctacaataaagtttaatttataggctgggtgcggtggctcacgcctataatcccagcactttgggaggcagaggcaggtggattacctgaggtcaggagtttgagaccagcctggccaacatagtgaaaccctctctctactaaaaatacaaaaattagccgggcgtggtggtacacgcctgtaatcccagctactcaggaggctgaggcagaagaatcgcttgaacccaggaggtggaagttgcagtgagccgagatcgtgccactgcactccagcctgggcaacagagcaagactccatctcaaaaaaaaaaaaaaaaaaaagtttaatttataaattaggcacagtaagagattaacaattaataataaaacaattacaacaatatactgtaataaaagttatgtgaatgtggtttctattttaatatttttggaccatggttgacctcgggtaactgaaaccacctaaaatctcacaggaggatatatattcaaaagaactggaggcagaatcaagaagagatttttgtacaccccgtattcatagcacaattattcataatagctaaaaggtggaagcaactcaagtgtccaatgacagatgaatgaataaacaaattgtggtatggtatatacatacaatgaaatattattcagcttttaaaaggaaagaaatcctgtcacatggatgaaccttgaggatatcatgccaagtgaagtaagtcagtcataaaaggacttatattttatgagtccgcttctaggaagtacctagagtaggcaaattcatggagacaaagtggaacagagattgacaggggctgtgaggagcagaaaatggagagctattgtttaatgtgagtagagtttcacttttgcaagatgaaaaagttctgaaaatctgttgctcgtgaatgtactcaacactattgaactatagactgaaaaacggttaagatgataaaaatttggtttttttaaccacaactaaaaaaaaatctgtattagagaaaatttcttgacttgattccaaatatatatttagtagaaggaatgccacctactgacaaagcagtttactagcaactccaaaattagcaagctgaattagccatctcccaaaatgcaaacatagcatgttcccgcctaaaatctgggatggttctttactccctggcactctaacacagtaatttccaatcttttgtctttcttcttttaagcagcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcgggggatgcccactacggattctccctggggagcgccctgattctgttcccatccccagcaaccttgcaactaactttgggtttatggaaacctgttgcgcgtccagcacttgggaaacccgtgaatggacacaaaccttcctttctttcgtcaaggagggcaagtccggctgagacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagtgccggacccgagacccggagggggggtgcccgggacaaagcgtcggctgcaaaagagaaaaggccaggcgaagacgctaggctctaaaacaccctcagtagaagcattaaaatgccctttcgtgatttatttccccttttataggtatttttaaacgttattttaaattacgtgttgacagtattcccctccagacgaatttagtagggcccattgtccttacgactacactacccacaatgcactacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggtaggtggggctggtcttggtgcagcccttggcaaagggcagtgggcacaaaagggtgagagctggactggaggctgggcccctcccctcacctctggtggtttgcacagcttcccgggacccttgagctgcctaccctggccatttgggaaaattcaaaggctgtgcagcttcctttccatgccctttctttcctttttttgagacagagtctcgctctgtcaccagactagagtgcagttggtgcgatctcggcacactgcaacctctgcctcccgagttcaagtggttctcctgtctcagcctcccgagtagctgggattacaggcacacaccaccacgcccagctaatttttgtatttttagtacagacgggtgtcaccacgttggccagaatggtcttgatgtcctgaccctgtgatccgcccacgtcggccttccaaagtgctgggattacaggcgtgagccaccgtgcccagccccgtgcctgtcctttcttaggaaaaggctttcttaggaatgccctcccaggcagccttgggcctcagcttctgaccaaacacaccagacctggtactacccagtcccggtggccaggtgcaagagtgtaaggaccattgtttttggctctgcccagggccacagctctgggatcacacactcccaagcttggggactattcttggtccctgttgtacaggcccaggtggggtacaggtcaggcctgctgaggacctctgcaccgtggggcccctctccctgtaactcatcccaccggctggttccacagcagctcccaggaagctgccacacattccagcagctgccctaagccactctgagcctgcattcttggggttctcccactgctccatgatggtagcctggccagacctaggagactccctgccactggatgtggcccagacatttctgggcagggcccccaagtccagtttggggcagataccaagtctcccttccggctgggcttagagctcttccctgcagcatgcccccttcatcagctgctctcttctgcttctagctttatgtcaaatgtcaaaaatgtgttaattcaaagtgcctagaacaaggctaaaaacagtgagctctcagtggctatgttagatggctctagacacccccattccgaggtgcctggcaggggccagcactgactcccaggccacacagcccctggaggaggaaggttacccagagtgcccccagcaggggctggcacaggtgctggttgtgagcaccattctgggcaggctgccaggccagcagggtgggtacaggctctgtagggagctgcgctgggactggcagaggagccaggacgaggggctagagccaagctgtggtactccaggcaaccagctgccagcacctcctcccatggcaaccctactgttgaccggcgtgtcctgcattcacccctgttcctgccccacccaccattggaaagggcctggtcggggattctacagacctctgtggccacttgatggggcttgggactaggcaagccctgagagggcagtggaaaacctcaccctgtgctgtgtggggcttggccctttctgggagaagccagcggcctggctgctcacccccagcacttcccacaccgcaggacccccactcaccagcctgtgttgagggcgcttcaccccgcatcttctgctggggtctgccgctgcccccgcccctgtcccatcccgggccccagggccccatgacgcagcagctcttctgaccgcagatcccgcctttctgggctgtagtaagtggtggctgtgtctcccacctggtgggaaggtggcagggaggatggggaaaagagccccagcctccagccctgggaggaggtctccacaggagtccttgggagggcggggctggtgggtgatgaatggggctgctggacacggaagatggctggacagagaacaggacacaggtgggagagagttcaaaccatttactaagcagattcttagccttcccactcccgccctctctcaagctccggtgcccacaagccttgcctggggagatgctggagtgagaccgggaggtccaggccaagtcactggtccctgggctcgggccctgccgatggagtaaagaccagctgtacacatcttccggtgggggccctgggctctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaagccccacccaggccctttctcgcactctcactctccagccccgctctgagtcccagcactgtctctctcatcccatggcaaacagagaggccaggcaggcgtgtggaggtcaggcccagggccccagcctcaccccccatgccactcactgcctctctggagcctgagtctctggcaaaaagcggtggcacaggggctttccccctgcctggcgacccccactctcccaagccgcaggggcttcccagacctctcaatcttcacaggggctgctcctcttcctgcggtactgcccgcaccccatccttgggggcccagttcaggtgacaccacttcaggaagttcccagtgacccagcacactgggtgtagcacccaggggcagtggtggccccaggcctagcagcctgctctggccttcagacaggagagacaaagggacacggaggggctgtgccctgccctcccaccagtggcgatggtgtccctggcaccccagcccccaggccaccctccggaagccaacttggagtttcctggccaggaggaagagcccccatccttgctggaggagggaggcgcgggatttccgggcattcttctgcacaatggcccagccatttctcgaaaggtccactggtgtggacactccgggccccctgaggctcaggtgggggcacgcggctccaaaacccacagccccatgggggcaccagcccctttctagtagttctttccccagtctctctcggcccctttgtttccagtaaagtttgaactccaggccctggactgaggccactgggtgcccagttcttttatctggtctgtgctcagttccattggacagggccctccatagaaaaagtatggcactgaggctggtcacagatgtgggaggtttgatgactttctccctcctggggcccggttcccttctcccccttcagatggctctgagatggtaaatgagataaggccagcgtctggctcacctagtgtggggaggttctgaaggcaagtgtgcccagccctgaggctggaaggaaatcataccctctttgctcagccccacgtggcctctccccaccaggtatggctctgaggaccactgccttctcccagctatcactttagtcactgccttcctcctgctgcagacccatgggccatgccccttcctctacagaccctcctggacatctcctcctctgtgtactccaggggtacagctgacccacccaccctctcactcttactaccccctaacccaagcccagggaacttccccagatccccctactcccagcccttccatgccaccatcttcctgggatgactgctgcggcctcctcaggtcatcagggacctgcccttgcccagctaggccacccaccccaccaggcccctctcctgggcctcaccctacctaagaccctccatggctcacattgcccatggacgaagagccgactcccagagcagctggattgatgtgtacctgcatgcgctaggactggccagtccagccaccagtcttggtgcggccctgagcacacactctgccccaggagacttacctgcctatgggcctcacatgggccgtctcttaccttggcctcttctgcccgcagcgtgtatctgtcaggttgggtcctgctcatcttctaagatgtgttgccgaggtcatttccaggaacaccttgctgcaccgtcccccagcattgcttttagaagcttgagctggacctgtccttttgcttgccgactttcccacctagtatccaggaataacctccacagggtggctgtcttcatgcgtctgtcctgcacaggaggctgcctgttgccctctagccagcttggagctgcagccagcccaaggctctcccttctcacctggctgcctgtttttcttctctcctagctgtcaccctagggtggccccagcaagctcatgtttctttggcggcagcctcacagcatctcagggacgtggcagaggagtctcaggcttcacctttcacaatctggtttctaccctgaccccactatgttggtcgaggccccaggctgcagtggaacaatgccaatgcagagaggcccagagagggccgcaggggctgacgccaccccagacaaacccacctcagatggaggctggcctctgagtagcccaggccagactccggaggggcatgagggtgcacccacctttcctgccactcatggagggtctgctcacctacttcgtggcaagcactgtctctaggcagagcacacagcacaagaagctcctgcccagaaggagctgacaggaacctatcaaccaagaactgggcaggaaagacagtggtgaaggcctctctgaagaggtgacatttcacagggatccggggaagaagttccaggcagagcagaagcaatagccagtgcaagatcccagaggtgggaaggggctcggcgtccaaggggcagaagcggccttgtgtccacagtgccacagtggtccagggcctgcaggtggagatcggaggtgtcctggttaggcagggacacaaacccctgatctctggtaaagggcccttggggcagagcactggccaaggccacctgctcacccccagccattgttctgctttcccaggggaagaatggcaggatctcattaattgtgtgtgagaagagcctgagtctgcagaaaagccaagtttatcttgagcagctgctggctgaccctgccccagggtaatcccgtgaccttccaaggataagctaaatttaggctcaagattcctggggatttgggtttgggaaactcctagttaacagatttgatttcaggggaagtgaagaacagcgtttcttctatctttcagttttgaaacagttaaggatgtgtccttctatttccgcaaatgtttgcagagcctccaagcacagtgtggcctggtgctctttcttgacacaagccagtactcctgcaggccgagagcagcagctggggtcctcctgcatccctgaccactgcaccaggtgcccgaggcaccctgtgtggggcccctgggcggctgtgacgatgtgagcagcatccagagtggacagtgccagactcggcggttttgcgggcattgttgttactctttgtggttaaacacaggcatggagtcagattcgctcccgcaagcaagaaactttctggactagtgaggtggcctctctgccttagttcctcactggtaacgaagccccccaatggtggaggctgcgaggctgcaggggaggccgatgccagtcccggttctcttctgcctttcctgagtgccatccacccaggctcccagggccttcacagctcatccaacctcagccgcacccctcagggtagtcatcgctggctgttagtcagaattggaggtcactgtggctttaacttccccagcgggtgagggagtggggggcagggagctctggtgtgatccacgaagggtcaagggttctatagaatggcaagccaggccaagcgcagtggctcacgcctgtaattccattcaggaggccgaggtgggcggatcacttgaggtcaggagtttgagaccagcctgtccaacacggtgaaaccccgtctctactaaaaatactaaaattagctgggcgtggtggcacgcacctgtaatccgttactcgggtagctgaggtgggagaatcccttgaacctgggaggcagaggttgcagtgagccgagatcatgccattgcactccatcctgggcaacacagcaagactccatctcaaaaaaaaaaaaaagtccaccaaagtacatcataaaccaaatttcgtaaaactggtgctaaagagaaagtcttaaaagcatggagaggaaaggccgggcgcagtggctcaggcctgtaatcccagcactttgggaggccgaggcgggcggatcacctcaggtcaggagttcgagaccagcctgaccaacatggagaaaccccgtctctactaaaaacacaaaaaatcagccgggggcttggtggcaggcgcctgtaatcccacctactcaggaggctgaggcaggagaatggcgtgaacccaggaggcggagcttggagtgagccgagattgtgtcactgcactccaacctgggcaacagagtgagactccgtctaaaaaacaaaacaaaaaaaagcatggagaggaaaaagacacattgtgtgcagaggaatcaagaagaaggagatttcttgttggaaacagtgcaagcaagaagatagtgtagcaatatctttaaagtactgcaagaaaaaaatccctgtaacctaaaattctttttcttttttctttttagaccgggtttcactttgtcatcgaggctgcagtgcagcggcacaaacatggttcactgcagcctcagcctccgggttcaagggatcctcccgcttcagccgcccaagcacccaaatagctaggactacaggcgtgcgccaccacacccggctaatttattttattttatttttgttttttaaattttttgtagcgatggggtttcaccatgttgtgcaggctggtctcaaactcctgagctcaagtgatccatttgccaatcccagtgctcggattacagcgtgagccaccacgcccagccttaacctaaattctatactcaccaaaaatgtattccaaaaatgaaggcaataccacatccatggatgagcctgaaaaaaataaatgaaggcagctgggtatggtggctcacgcctgtcatcccagcactttgggaggctgagacaggtggatcacctgaggtcaggagtttgagaccaacctggccaacatggtgaaaccctgtctctactaaaaatacaaaaattagctatgtatggtagcaggtgcctgtaattccagctacttgagaggctgaggcaggagaatcgcttgaacccaggagacggaggttgcagtgagctgagattgcaccactgcactccagctggcatgacagggcgagactccatctcagaaaacaaaaacaaaaaaaatgtttttaaataaagacaaaacagacttctgcttcctagaagacagataaacatatgtttccctattccttccacaaaaaaaccctaaatgttataaataaagcaaacataagaagatgctaagtgttacaaagaaggcagacaagctagagacttagagccaaggacgaaatggtggtgtttctctgggttgcctttttgtttttttttttcttattttatttatttattttagaaatagttctcattctgtcacccaggctggagtgcagggacacaaccatagctcactgcaactttgaactcctaggctcaagtgattctcccacctcagcctcccaagtagctgggactacaggtatgcaccaccacccacctaatacttttaaaaaatttttgtagagacggtcttgcaatgttgctcaggctgatcttataactcctggtctcaagggatcctcctgcctcagcctcccaaagcactgggatgacaggcatgagccaccatgcccagcctcctgggttatctttttgactcatgtatcccagactgcatacagaggagctggccacccagaaacaccaatgggtacaggcaaaaaataagtcctaagcaaagccggttctgtctagccaaaagatcaggacaaagacagactaacaagacaaaaatattttagacaataaccactctactcaagctatactactacagaaaaaaactgtggccccaaccctgccctcaatagcaaagaccagtggggagcttagactcctacccttgccaggctgtaatgagatgctccagcctcctactggggtgtcagaggaggccaaggaagacttgggtggaaataggtccccctccctgaccacagtgtcagtggagaccacatggggagcctggacttccactcctaatgtggtaataagggccccctccaggtcctcactatggtactgtcagaggaacctagcagagggtaaggacattcttcattttccagaggtgatgaggctctccctgcccacacatggtgccagtggaggccacgtggggatcagcagcaggcattcctcccatccatgcctggggtatcacaagaggccgagtggggagcaggaactcccagccccacccagcagtcacaaggatccccgtggccccaggtgtcaatggaggtagggtggagaacctggacttccacttctgcctggcagtaaagtgtcccctgtcattgccagaatggtgtcagaggaagcttgctaaaatacaagatttaaataagatccacagtcttgtaataaccaaattatccaagttttgattgaaaataagtcatcaggctgggcggggtgtctcacgcctgtaacccagcactttgggaggctgaggccggcagatcatgaggtcaggagattgagaccatcctggccaacatggtgaaatgccatctctactaaaaatccaaaaaaattagccaggcatggtggcacacgcctctagtccccgctactcaggaagctgaggcaggagaattgcttgaacctgggaggcagaggctgcagtaagccgagatcatgccactgcactccagcctgggcaacagatcaagaccctatctcaaaaaaaaaaaaaaaaaaaaaaagaaaagtcatcataccaagtatcagtaagatattaaactaaattggccaggtacaatggctcatgcctgtaatcccagcactttgggaggctgtgggcagatcgcttgaggtcaggtgttcgagaccagcctggccaatatggtgaaaccctgtctctacaaaaaattagccaggcttggtggtgcacccctgtagtcccagctactccagaggctgaggcatgagattagcttgagcctgggaggcggaggttgccgtgagctgagatcgtgctactgcactcctcctgggcaacagagcaagaccccgcctcaaaaaaaaaaaaaaagaaagaaagaaagaaaatcgacaaagatggcaatgtcacagatgtgagaattacttcatatttcaaagcagaaatgataaaaatgcttcagtgagcaattacagatatgcttgaaacaaatgaaaatatagaaagtcttacaaagaaataagaaccacatagaaattttagaactaggccagccatggtggctcatgcctgtaatcctagcactttgggaggccgaggtagatgcattgcctgagctcaggagttcgagaccaacctgggaaacatggtgaaaccctgtctctactaaaatacaaaaaaattagctgggcgtggcggcgtgcacctgtaatcccagctactcaggaggctgagagaggagaatttccagaacccaggaggcagagattgcagtgagctgagatcgtgccactgtactccagcctgggtgacacagcgagactctgtctctgaaaaaaaaaaaaaaatttagaactaaaatacagtaaccaaaattaaaaaaaaaaaaaaaggtcattggggctgggcgtggtggctcacgcctgtaatcccagtactttgggaggccgaggcgggcggatcacgaggtcaggatcctggctaacaaggtgaaaccccgtctctactaaaaatacaaaaaaattagctgggggtggtggagggcacctgtagtcccagctactcaggaggctgaggcaggagaatggcgtgaacctgggaggtggagcttgcagtgagccaagattgcgccactgcactccagcctgggcgacagagcaagactccgtctcaaaaaataataataataaaaaggtcattggatatcagctggacagcaacatggaagggacataggaaactattggtgaattggaagctagaacagtgcaattttcccatctgggccagccacagtggctcacacctgtaatcctagcagtttgggaggctgaggcaggaggattgcttgaggccaggagttaaagaccaactggccaacacagtgagacgtgtctctattaaaaacaaaattttaacccaattatcccatctgaacaagagagagaaaatcactgaaaaaataagaataaacaaaggctcagaaaatgtgagatcataacaaaagacctaacatccatgtcatgagagtgccaaaaggagaggagaaagggggtggggttaacaaagcattcaaagaaataatagctggaaatttcctgaatttagcaaaaagaaaaagagagagaaaaaaaccctacagattcaagaagttaagtgaggccgggtgcggtggttcacacctttgggggccaagatgggtggaccgcttgagcccaggagttcaagaccaacctgggcaacacagtgagacccctgtcgagagagagagaggagaaaaattaaatggaaccttaaacatgataaactcaaagaaatccacactaaaacatctttttttttggagacagattattgctgtgtcgcccaggttggagtgcagtggcacgatctcggctcactccaacctctgcctcctgggttcaagagattcttctgcctcaacctcccaagtagctgggactacaagcacatgctgccatgtccagctcattttttttgtatttcagtagagacagggtttcaccgtattgcccaggctgatcttgaactcctgagctcaggtgatctggcctcctcagcctcccaaagtgctaggattacaggcggcagccaccgctccaggcccaaaacatcttaattgaacttctgaaacctaaagacaatgcagctagacagaaaaatgacacctcacctattggagaagaaaatgaatcaaatgacagagaatttctcttcagaaaccagggagaccagaagaaagtagcacattttttaagtgctgaaagaaaaaaaaaaaaatctcaatccagaattctatgtctagtgagcatattattcaagaatgaagggggaaaatttttttttcaagtgaaggaaaatgaagagaatttattgccagcaatatatgctgaaagaatgctaaaggatgttccttaaacagaaaggaaatggtaaaataagagtcttggaacatcaggaaggaagaaagaacatgataagcaaaatactggtaaatattaatacaatagattttcttcctcctcttgagtttcctaaattatgtttgatggctgaagcaaaaattattacactgccttaagtggttctcaatgtatgtagaggaaatatctaagatatataattatattataaatgggggagggtaacaagacattaagggaggtaaggttttttgtttgtttgtttgttcgtttttgagatggagtctggctctgtcatccaggctggagtacagtggcaagatctcggctcactgcaacctctgcctcccgggttcaagtgattctcctgcctcagcctcccaagtagctgggactacaggcgcccgccaccaggcctggctaatttttgtatttttagtagagacagggtttcaccacattggccaggctagtctcaaactcctgacctcaggttatccgcctgcctcagtctcccaaagtgctgggattacaggcatgagccaccatgcgcagctgggaggtaaggtttttttttttgttttttgtttgtttgtttgtttgtttgtttttgagatggagtcttgctctgttgcccaggctggagtgcagtggcgcaatctcggctctctgcaagctccacctctgggttcacgccattctcctgcctcagcctcccgagtagctgagactacaggcggctgccaccaagcctggctaattttttttgtatttttagtagagatggggtttcaccgtgttagccaggatggtctcaatctcctgacctcatgatccacccaccttggcctcccaaagtgctgggattacaggcatgagccaccatgcccggccaccgggagataaggttttttacacttcattccaactggtaaaatgttgacacctggagactttgattatataatataaattttatatatatttatcctacagcaaccactaaaaagctatacaaaggtatcaagaagaaaaaaaaaataacaaatgctggtgaggttgcagagaaaagagaactcttatacactcttggtgggaaagtgcacccatctggtaccataaactagcccaaccacaatagagaacagcacggagggtcctcataaaaactgcacatagaaataccataccatctagcaactccatgactgggcattaatccaaaggaaggaagtccgtttatcaaagacacatctgcacccttatgtttaccgcagcactgttcactagccaagacatggaatcaacctaggtgttcaacagcagaggaatggataaagaaaagttggtacatatacacaatgaatactattcagccattaaaaaaaaaaaaaagaaatcctgtcattcatggcaacataaatggaactggagaacaatatgttaagtgaaacgagccaggaacagaaaggttatttatttatttatttttcacttatttatttatttattgagacagagtcttgctctgttgcccgggctggagtgcaatggcatgatcttggctcactgcaacttctgcctcctgggttcaagcaattctcccacctcagcctctcaagaagctgggattacaggagcgtgccaccatgcctggctaatttttgcattttgagtagtgacggggtttcaccgtgttagccaggttggtctcaaactccttacctcatgatctgcccgcctcagcctcccaaagtgctgggattataggcatgagccactgtgcccggctgatgttttattttttagagatggggtctcacaatgttgcccaggctggtctcaaacttctgggttcaagtgatcctcctgcctcaccctcccaaagtgctgggatttcagggaggagccaccacacacagctaagacagagttaaacaccacatattcttattcatatgtagcagcttaaaaaagttgatcttggctgggtgcagtggctcatgcctgtaatcccagcactttgggaggccgagggcgggtggatcacgaggtcaggagatcgagaccatcctggctaacacggtgaaactccatctctactaaaaatacaaaaaataataataataataattagccaggtgtggtggcgggcacctgtagtcccagctactcgggaggctgaggcaggagaatggtgtgaacctgggaggcggagcttgcagtgagccaagattgcgccactgcactccagcctgggcaacagagcgagactccgtctcaaaaaacaaaccaaaaaaaagataaataaaaaataaaaataagtaataaaaataaaaaacaataaaaattaaaaattaaaaagtatatttaaaaagaggtagagctatatgcactgacctggacatatctctaacagatcttattaagggaaaaaaatcattcaagtttatcacattacatatacaatgatactgtgtaaacttaaattcccacaaaaatgaaactatgtaattttttttgttttgtttcattttgttgttgttttttagtgagacagagtctcactctgttacccaggctggagtgcagtggcatgaacatggctcactgcagcctctacttcccgggttcaagcaatcctcccacttcagcctcacaaggagctgggaccacaagtgtgcaccaccacgcctgcctaatttttgtatttttctgtagagagggggttttgccatgttgcctaggctggtctcaaactcttaggctcaagcaatcctctgcctcggcctcctaaagtgctgggattacaggtgtgagccacctggccaaaactatgcacttttttttttttttttttttttttttttgagaaagagtctcgttctgtcgccaagctggagtgcagtggcaggatctcaattcactgcaagctccgcctcccgggttcaagcgattctacctcggcctcctgagtagctgggactacaggcgtgtgccaccacacccagctaacttttgtatttttagtagagatggggtttcaccatgtttgccaggctggtctcgaactcctgaccttatgatccacccacctgagcctcccaaagtgctgggattacaggcgtgagccaccgtgcccagccccaactatgtacttttatgtttatttttatgaatacaaatggacagataaaagtctaaggcatagatgccaaattgatatctattattgcctatgtgtaggagactctgggatttactgggggagacatcagggattttttactttctttgtattctgtactttttctatatttcacgactttctatattgtttgaaagtttacaacataaatgtatttacatcttacctacaaaattattatttctttaatgaacagttgtagcttatatataattccttcagaataaataaataaaagaaaggaagaacacgggggaaaagctatacaaagagacacactcaaaaacactgtagataactcaaaatgtaattttttttttttttttttgagacggggtctcactctgttgccgcccaggctggagtgccgtggcgcaatctcggctcactgcaacctccgcctcccaggttaatgacattctcctgcctcagcctcccaagtagctgggattacaggcaccccccaccatgcccggctcattttttgtatttttagtagagatgggatttcactgtgttagccaagatggtctcgatctcctgaccttgtgatccgcccgcctcggcctcccaaagtgctggaattaacaagtgtgagctacggtggccggcctcaaaatgtaattttaaggaatattcaagtaagccacaggaaagcagggaaaagtaaagagaaatgaacaaaaagagacacaacaaacaaaaaaataaaaataaaatagcactcttgggccaggcgcggtggttcatgcctataatctgagcactttgggaggtggaggcgggcagattacttgaggccaggagtttgagaccagcctggccaacattgcaaaaccccatctctactaaacatacaaaaactagccagtcatggtggtgcccacctgtaatcccagctactggggtgcctgaggcatgagaatcgcttgaacccaggaggccaagaggcagaggttgcagtgagctgagatcacaccactgcacttcagcctgtgacagagcaagcaagtaggcaggcaggcagagagaaaggaagaaaagaaggagagacggagagagggagggtggaggggggagggaaggaggaaggagggaaggaaggaaggaaggaaggaataattactagaacaaagacattacataatgatgaaagggtcaattcaccaagaagacacagcaattctaaatatataggcaccaaacaacagagcttcaaaatatgtgaggcaaaactgataaaactaaatggagatatagataaatgaacaattgtagttgaagcttcaacatttctctctcaaaaattgatagaaaaagtagacagaaaatcaacaagaagacagaatctcaaacaccatcaactaacaggatttactccacatttacagagcactacctaacagcagtggatacacattcttttctagtgcccacagaaccaaccatatcttgggccgtaaagaaacctcaaaatcaatgaaaccaaaagttggttctttgaaaagttcaacaaaattgacaaatcttcagctagattgacctaaaaagagggaggaaacccaaattacctaaatccggaatgaaagaagagatatcacttgtgggcttacacaaataagagtgattttatttatttattctactttattttatttttttgagatggagtctcactctgtcacctaggctggaatacagtggtgtgatctcagctcactgcaacctccacctcctgggttcaggtgactctcctgcctcagcctcccgagtagctgggattacaggtgcccaccaacatgctgggctaatttttgtattttgtatttttagtagacacggggtttcaccatgttggccaggctgatctcgaactcctgacctcaggtgatccgctggccttggcctcccaaagggctgggattacagatgtgagccacaacacctgaccaaaatagtgattttagaggaatactatgaacagttgtatgccaacaaattagttaacctagatgaaattgaccaattcttagaaacatagactaccaaacctgactcaaaaagaaatagaaaatctgaatagatctataacaagcaaatataatacaaaaaattagccgggcatggtggcagatgcttgtaatcccagctactcgggaggttgaggcaggagaatcacttgaacccaggagatggaggttccagtgagtcaagatcgcaccattgcactccagtctgggcaacaagagcgaaactccatctcaaaaacaaacaagcaaacaaacaacaacaacaaaaaacacaagcaaatataacaaacaaacggattgagttaggaaaaagaaaaaaaaaaatccaacaaagaaaagtctaggaccagatggcttcactggtaaattctaccaattttttttttttttcgatggagtctcgctttgttgcccaggctggagtgcagtggcgcaatctcagctcactgcaacctccaccttccgggttcacgccattctcctgcctcagcctcccaagtagctgggattacaggtgtctgcaaccatgcccagctaatttttgtatctttagtacagacagggtttcgccatgttggccaggctggtctcgaactcctgacttcatgtgatccacccgcctcggcctcccaaagtggtgggattacaggcgtcagccatggcgcccggccctatcaaatgtttaaaaaacaactagcaccaatccatctcaaactctcttacgaaaaagaaaaaaaagagagagggaattcaatccattctatgaaaccaatattactttgacaccaaaagtaaagcaaaaaaaaagaagaagaagaaaggaaaaagagagaggaaactacagaccaatattccacatgaatatagatgcaaacattcttaacattttataaaataaattcagccgtatataaaaataattatacaccatgatcaagtgggatttattcctagaatacaagcttggttcaacttccaaagatcaatcaatgtataccaatgtaagctaaagaagaaaaatcacatgattatattaattgacacaaaagaagcatttgatgaaattcaacacccattcatgataaaagctgctggtaaccagtaatagaaacttcctcaacttgataaacagtgtctacaaaaaacctacagctaaaaattatacttaatagtggaaagctgaatacttttctgtgaaaattagggacaaggcaaaaattctgccttcactactcttactcagtatagtgctggaagttccagacatcacagaaaggggagaaaaggaaagagatagagatcagaaaggaaaaaccaaagctgcttctatttgcagatgacataaatcaattcccatggaatcttttaaaaagccttagaaccaacaaatgagtttagcaagatacaaggattcaagatcaacatacaaaaatcaattgctatttctatgttctagcaatgagcacatgaaaaccaaaataaaaaataatatcatttgcaatcactcaaaaaatgaactaggtgtaaatctaaccaaatatgggtttgtatggataaggacttgtatgctgaaaactacaaaaccctggtgaaagaaatcaaagaagatgtaaataaatagagaggtatggcctgttaatggactggaaaactcaacatggtgaagatgtgaatagttcgattcctttcaaaattctagaaagatttcttggccaggcacggtggcccatgcctgtaatcccagcactttgggaggccgaggagggcggatcatgaggtcaggagtttgagaccagcctgaccaacatggtgaaaccccgactctactaaaaatacaaaaatcagctgggcgtggttgtgtgtgcctgtagtcccagctactggggaggctgaggcaggagaatcacttgaacctgggaggcagaggttgcagtgagccaagatcacgccactgcactccagcctggacaacaaagcgagactccgtctcaaaaaaaaaaaaaaaagaaaaagaaagatttcttatagatataggcaagattattctaaaatttataagaaaaagcaaaagaattaaaatagttaaaacaattccaaaaaagaagaataaagtgggaagagtcactctaccaaatttcaagatttgtatagactgtttggcattggtgaagggatagatacattttgttcaatgaaacagcctagagaacccagaaacagccccatgcaagtatagctggctgatttttgacaagcatgtacaagcaattcaatgatacaaaggaatcgaaaccaggaactcaaacagacatttgtacctcagtgttcatagcagcatcattcacaacaccccaaaggtggaaaaacccaaatatccatcagtgaatagcaagataaacaaataaccaaacctaaaagtggcatatccatacaatggaactttattcagccttaaaaagaaagaagattccagtacatgccacaacatagatgaaccttaaagacatgataccaggtgaaataaaccaaacgcaaaaggacaaataccgtatgattccactgacatgagggagaggcctggagtagtcaaattcatggagacagaaagtggaatggggattgccggggtgggggcgtgggacagagtgcaaaatagggcttttctgtatctattgaaattttgttgctgttgttgttttattctgttaatgtcgtgattcacactatgtaattttatatcaaccctgtatttttgcgataaacccaacttagtcatgatgatttatgttgtttttttcttttttgagacggagtctcactctgtcgcccaggctggagccatctcggttcactgcaaccttcacctctcgggttgaagagattctcctgcctcagcctccgagtatctgggattacaggcgcgtgccaccactctgcctggctaatttctgtatttttaatagagacggggttttaccatgtcggccagactggtcttgaactgctgacctcaggtgatccacctgcctcggcctcccaaagtgctgggattacaggcgtgagccaccgcgcccagccaatttctgtatttttaatagagacggggttttaccatgttggccaggctggtcttgaactcctgacctcaggtgatctgcctgcctcggcctcccaaagtgttgggattacaggcgcgagccaccgcgcctggtcgatttatcttttttatacattattggattcagtttgcatctctgttcatgagtgaaatttaccagtaattttatttttttgtcctgttcttgttcagtttgtatgtcaagattacgttagttttataaaactgaagtgaaagtgtttctcacttttctattctctgaaataatttgtacaaggttggaattatctgttttttgaaaggcagaatttgcttgcaaagttattttaacatttttgggggaggaggggaatattttaaattactgattacatttctgtaattgttgttaagacaattgaggtttatttcttttttattccattaaaagaaacctgtgtttttccaagaaattatccagttcatctgttttcaaacttgttggcataaagttgatataagagcctcttatattttcatatacttgctgacacacccatgttaaatctgttttgtcctggtgttttttatttgtgcatcctctcttcttcttgttaatacttccagaagcttggctttatatttgtatttccaacaaatcaatgtttgactttgctgccttaaattttatttaatctgatattgaccaaattaacaatttttctcttggttagtctttgcacagtatatctttctttcccttgacattcaatttttctttttctttctttttcttttcttttctttttctttttctttttttttttttgagtcagggtctctgtcacggaggctggagtgcagtggtgcaatcatagctcactgcagcctccaactcctgggcttaagtgatcctcccaactcagcctcccaagtagccgagaccacaggtgaaacaccaccacaccaaacttctttttcttttgcagagacagggtctcaccatgttgcccaggctggtcttgaactcctgcctcaagcaatcttctgccttggtctcccaaagtgctgggattacaggcgtgagccatcacacccagcccatttgggtttatttgtgacattttctgcccagctttcccactcattcctcctttcttgcatcttttgggtgtgagagagagaatgtgtctttttttttttttttttttttttttttagagacggagtctcgctgtgtcaccaggctggagtgcagtggcaaaatttcggctcactgcaacctctgcctcccgggttcaagcaattctcctgcctcagcctcctgagtagctgggactacaggcacacgccaccatgcccggttaatttttgtatttttagtagagacagggtttcaccatgttggccaagctggtcttgaactcctgacctcaagtgatccactcgcctcagcctcccaaagtgttggggttacaggcgtgagccaccgcacccagccacgtgtgtgtcttttattccctgctttcccttctgcctgtttggcacttataactactgtgcctatttcatggatgccctccaaagttaatatctgaggttaatgtttttccctcctcccattccaatgggtattctcccaataccagagccttagcatgtatcacctgctaccagctcacatgccattgttgcccagcgcacgtgctgggtgtactggtgtgcagagtccaacgggagggctgggagaaggcccccgacctccctgccctctcagactgtggccgcacccagcttgccagacggagagcccaggagcaggaagctggtgtaaacacagggcgggcacccacactgttcccaggagccagtccttagatcctatctggctctcaccctgcctttgtcaagccctcaggacttggcacccaggtctgatctgggtgggcgtttgtccaaacaagaagtgagccagagctggacatccaggaccagaccataccacacagagggcatggggacactctcccagggcctgcagcccttcccggggctgctcttggcagcccaggcaccctggaggatatgcagtgcctctctgcccacccacacccctctggggctggcagggcctggagtgtgcgtgggcatgcagacgcatacacatctagcccttggctctcctcattggaccccttcagacactcctttctcttcacacttttacggaaaaggcacaagtggggatgtcctgccctgtgactggccttggctggcctggcccctgtagcacacgctggtggaaggaatgtccacagtgcagaaggcgctgctgcagaccgtgggctcacccgttctcattccacctgcaggtggaccaagcctggggtggcggggacaggccccacagactgaagtgacaggggatggagaagggctggggacagaggggacacagccacctacctggcaagctaagaggtcgggaagagtagctgccacttacatgggtttagacaaacaaacaggagttcaccagggtgaagggaaacgggagacctggctaaaagcaggaaaaagtaccagcatgggagcgggggcaacagcagaaccccagggagggtcagatggggtgcagcgccgggaggccagccagttccctggaagagagtttgcaggactaaagcctagagcctagattgctgcaaagtttcccagaagcggctgttgaacaatagtcacggccgggcacggtggctcacacctgtaatcccagcactttgggaggccaaggcgggcggatcacgaggtcaggagattgagaccatcctggctaacatggtgaaaccctgtctctactaaaaatacaacaaaaattagctgggcatggtggcaggcgcctgcagtcccagctacttgggaggctgaggcaggagaatggcatgaacctgggaggtggagcttttagtgagccgagattgcgccactgcactccagcctgggcgacagagcaaaactctgtctcaaaaaaaaaaaaaaaaaaaaaaaaacaacaatagtcacacggccacatctagctgggaggaaaggtgaaatatgttttagctgggtggccacgactagtgaaacatgaggcctgtatttttgctggggcagtgagcatccttggccacatgctgggctccagggggacggccaggggcattggccagggaaggagcccaggagagcaaacagaacctgcatactcactcccctccctcccagtcccatttaatctaactgtgaagacagtgaaaactaataagcccacagtaagaggggaaatactcgagactgccatcagttgaccagaaattttggaagagtttgaagaatttttgggagacaggaagcagataggatcagggcatagttaagggcacccaggcagaagccacggccctgaaggagcccccggcaagggcagggatggctgcagttgccagctttagccctgagagcagctttgtgaggcaggcagagcagttcccgggagggcccaccacagtggtcagagaggcagcaaactggctccgccgtgcagctttgggcggaaaggcaggtcctgccaggaaagaaaccaagcagagtcagttaaaggaggtctcctggtggtcctagagtgttgtgggggaggttacgaacaggtcttccacacacctggtgggagtgtgaggtgacacaaccacttggagaacagttccccagtatctcacaaagcagaacgggtgcgtagcccatgagccagaaaacaaggacccgtgtgtgccagagtagtgatacgagaatatccatgggagcattgcccttaatcccttaatagtgctaactagagtgcacacaagtgtccatcaacaataggctggatgaatgcactgtggtatattcacacagtggaatacatgcaatgcagagcaacacacagcttgtatgaattttataaaggtaacagcgggtgagaggcacaagcccctgaactgtctactgtatgattctgtggcagattgtattttccaaagatgccaccaaatgtagagacattcaaagatatcacccattggacattctctttttcattttacttttgtaaaaattgcgggcggtggtgatggttgtacaacaatgtgaatatactattgctactgaactgcatactgaaaatggctaagatgaggccgggcgcgttggctcatgcctgtaatcccagcactttgggaggccaaggcaggtggatcacttgaggtcagaagtttgagactagcctggacaatttagcaagaccctatctctaccaaaaaacaacaacaaaaaacacatttttttttcattagccaggtgtggtggcacatgtctgtagtcccaggtgttcaggaggttgaggcaggaggatcacttgagccacgaggtcaaggctgcagcgagctgtgattgtgtcattgcactcctgagtgagatcctgtgtctaaaaaaagaatgtggtaaaatatacatgacatgcactttacttttttttttaaccgagttttgctctgtctcccaggctgcagtgcagtggcgcaatcttggttcactacagcctccacctcccgggtttaagcaattctcctgcctcagcctccctagtaactggcattacaggtgcacaccactacacccagctaattttgtatttttagtagagacgggattttgccatgctgaccaggctggtctcgaactcctgacctcaaatgatccacctgcctcagcctcccaaagtgctgggattacaggcatgagccactgcgcccggcctcatcttaaccattttcagtatgcagttcagtagcaataggtacattcacattgttgtgcagccatcaccaccgcccatctccagaactcttttcatcttgtaaaactgatactccatacccgccaaacactacctccccagtaccctcctgttccagtccctggcaaccatatctactctctgtctctatgaatttgactactctaggtacttcatgtaagtggaatcatacatgaggtatttgcccttttgtgactgacttgtttcactaagcataatggcctcaaagttcaaagttcatatattttgtagcatgtatcagtacttcatgaatttttttttgttttgagacagagtctcactctgttgcccaggctggagtgcagtggtacagtctcagctcactgcaacccccacctcccaggttcaagcaattcttctgcctccgcctcccgagtagctgggactacaggtgtgcgccaccataccgggcttttttttttttttttttcgtagagatggggtttctccatgttggccaggtctcaaactcccaacctcgagtgatccacccaccttgacctcccaaagtgctgggatgatacaggcatgagacaccacactcagccttgttgttgttgttgttgttgagacaggatctggctctgtcacccaggctggagtgcagtggcctgatcatggctcactgcagccttaacctcccaggttcaatcaatcctcccacctcagcctcccgagtagttgggactacgggtgcacgccaccatgccttggtaatttttttgtattttttgtagagaaagttttgccatgttgcctgggctggtctcaaactactgggctcaagcatccacctgcctctgcttccctgaatgctgggattacaggcgtgagacaccatgcctggcccttcattccattttttttttttttttttgagacagagttttgctcttacacccaggctgaagtgaagtggcgcgatctctgctcactgcaacctccgccccccaggttcaagtgattctcctgcctcagcctcctgagtagctgggattacaggcgcctgccaccacgccctgctaatttttgtatttttagtagagatggggtttcgccatgttggccaggctggtcttgaacttctgacctcaggtgatccacccgcctcaacctctcaaagtacaggcatgagccaccgcgcctggccccttcattcctttttaaggctgagtaaaattcccctatatagttatattacatttgtttatccattcatcaaccaaaagtccacttggggccagggatggtagcttgcgcctgtaatctcaacactttgagaggccaaggtgggaggaccacttgagcccaggaattcaagaccagcctgggcaacatagcaagaccccttctctacaaaaaaaattggccaggcatgatgatgcatgcctgtagtcccagccacttgggaggctgaagtgggaggatcgcttgagcctgggaagttgaggctgcagttagcagtgatcgcaccactgcacgtgagtctgggtgacagtgagactgcctcaaaaaatgtttttaaaaatacagtcgtattggctgttccaaatgatggtgccatgaacatgggtgtacaagcatgtgctgctcttatgatacaatgctgatgtgctccccatcaaaagctggggtctatattccctctccttgcacctgggaaggttgtgacagaaatgatgctatgtgacttccaggctagatcataagaggtgatacaacttgctcctcatcctctttagtggctcactcttggagcccagtcgccatgttgtgagcaactcagaccagacttagaggccacatgtagatgttccagctggcagccagcatcaactaccagatagagggaaagagttttccaagcaaccccagcctctgtgactatctgagcaagaaccacccaggcgagcccagtcaaccccagagccatgagagatgacagaaatgactgttgctgtttcaggccactgaggtttggggtgtttggagtgcagccactacatgcaccctacaaagaagtctgccctgggatgggaccccccacatcccacagccacctccaaacacaggaccagagaccccaggatcagcaggccaaaatgaccataaaggaagcccaagcttgccaccctgtcaacgaggaagtcccagatgggagatagtaatgcgagaacaaaggaaaacgtaagcaaccttgatgatgtgaaataatagtaaagctgatggaaacggggaggtagagcaggaagatttcttcatcttgcacagtggggtccgtcataaaatatctacagcaatagaggtctggggcaggtccaggctccactaggtggctgtaaggtggcttgttggacggacccgagtcactggtgtcactagtccctgaaatcacagcatctccactgctctgacaatgacaggtttagaggttaggccccagcctgctgggtatgcatttcctttagtgctggagatggactcagaatgcgtatgtgaccctatgtgggccagcaattggccagtgcaagattgctggggattctgggaccggggtccttattttcaagatacagccatgtgaaaaaatggctcctaccaacacacgaagagggaaactccgcactcctattgcttggcagccatccttccatcactaagggaaccagccttaggataaagctgaggggtggagcaatggaaggtactcaggtttctatcacagtttttgtttgtttgttttttgagacagagttttgctcttgtagcccaggctggagtgcaatggtacgatctcagctcactgcaacctctgcatcttgggttcgagcgattctcctgcctcagtctcccaagtagctgggattacaagcgcccaccaccacgcccagctaatttttttgtatttttagtagagatggggtttcaccatgttggccaggctggtctcaaactcctgacctcaggtgatctgcccgcctcaggctcccaaagttctgtgattacaggtgtgagctactgcgcctggccccagctaatttttatatttttagtagagatggggtttcaccatgttggccaggctggtcttgaactcctgacctcaggtgatctgcctacctcagccttccaaagtgctggaattacaggcatgagccactgcgtccagcctctatgatggttctgtaaagcctgtaagctgaacagccctggagcctgccttacctctgaacatccactggcatgagccaataaattgctatattaagaccgttctagttggatttttttccttttttttttttttagacagggtgtcactctgtcacccaggctgcagtgcagtggtgtaatcatagctcactgcagtctcaaactcctgggctcaagcgatcctcctccttcagcctcctgagtagtttggactacaagaacgtgccaccacacctggtgaatttttaaatttttcttttgtagagacgaggtcgtgctatggtcaccccggctagtttagaactcctggtctcaagtgatcctcccacatcggcctcccaaagtgctgggattataggcatgagccaccatgcccagctgtttctttcctttttaaaacattttttattgagatacaattcacataacataaaattaatcactttaaagtttatacttcagtggctttagtatattcactatgctgtacatgcatcgccacggtgtaattccagaacatttccatttccccaagagaaaccacaaatctgttggcagttattctccacttctccccaccccatgccctaggtatccaccaatctactttctgtcttcgtggatttgcctgttctggacatttcatagaactggaatcacacagcatgtgggcttttgtgtctggcatctttctctccgtagattttcctattctggacatttcatagaaccggaatcacacagcatgtgggcttttgtgtctggcgtctttctctccatggatttgcctgttctggacatttcatagaaccggaatcacacagcatgtgggcttttgtgtctggcatctttctctccgtagatttgcctattctggacatttcataaaactggaatcacacagtatgtgggcttttgtgtcgggcgtctttctcttagcacagtgtttccaggttcatccgcgctgtagcctcattcaacacctcattatctgtgacgctaaataatattcctttattctgtttatccatttacctgttggtggtcatttgtgttgtttccatttttgggctattgtgaatagtgctgttatgaactttttttttttttttttttgagacagagtctcgctctgttgcccaggctggagtgcaacggcatgatcttggctcactgcaacctctgcctcccgggttcacgccattcttctgcatcagcctcctgagtagctgagattataggcgcccaccaccatgtccagctaatttttttgtctttttagttgagatggggtttcaccatgttggccaagctggtctcaaactcctgacctcaagtgatctgcccaccttggcctcccaaaatgctgggattacaggcgtgagccaccgcacctggtcgattactatagttttgtagtaagttttgaaatggagaagtgagtcttctaacattgttcttgtccaagactgctttggttctttctgtgtcccttgcagttccatatgaattttagaatcagcttgtccatttctggaaaaaaaaaaaaagctgttgaaactttgataggtattgcattaaatctgaagatcttaatgttaagttttctagtccacgaatatagaatatctttccattttctttcaacaatgtcttgtagattttttatagcagccttgcactttttaaattaaatttatttctaagtatttcaagactattcttttgatgctgtattttcttaatttgattttcaaattgttcattgccagtagatagaaatgcaactggttttgtatattaatcttgtatcctgcaactttactaaactcacttattagctctaccagtttttgtgcagattctttagggttttgtttggttttgttttgacagggtctcactctgccacccaggctggagtgcagtggcatgatcatggctcactgtggccttaatcttccaggctcaggtgatcctcccacctcagtctcctgagtagctagaactacaggtgtgtgccaccatgcccagctaattttttgtagagatggggttttgccaggttgcctgggctggtcttgaactcctgggctcaagcaatccacccacctcaacctcccaaagtgctggtattaaaggcataagccaccatgcccagtttctttagggtattctttatacaagatcatgtcatctgcaaatggagttttacttctttctctccaatctagatggctttttgttattttttcttgtctagttgcccagcctagaatttctagtacaatgttaagtaagtggcaagagtggccatctttgtcttgttcctaatctcaggggtaaggctttcagttttttaccattaagtatgatattagctgtgggcttttcacagattccctttatcagactgtgcgagttccctcctattcctagtttagtgcatgatttttatcactaaagggtatcctgactttgttaaattttttttttttttttttttttttgagatggagtttcactcttgttgcccaggctggagtgtgtgatctcggctcactgcaacctctgcctccccatttcaagtgattctcctgcctcagcctcttgagtagctgggattacaggcacccgccaccacgccccactaattttttgtatttttagtagagatggggtttcaccatgttggtcacgctggtctcaaacttgtgacctcgggtgatccacccgccttggcctctcaaagtgctgggattacaggcatgaacgaaccaccacaccctgcctgttaaaggtttttgtcaaattcttttgtgcctatttagatgaccttgtggttctgtccctttattctattaatatgatgtattacattgattaggttctgtgttttaaaccaaccttgcattcctgggatagatcctacttggtcatggtgtacaatcctttaacatgttgctgaatttggtttgttagttgtttgttaaggatttttgaatccaaatttataagggatattggtctgtattttttattgtgatgtctttgtcgggcttcacagcataagtcagtaagtgttccctcctcttctgttttttggacacatctgagaagtactggtgttaacccctctttaaacatttggtggaatttgccagtaaagccgtctgatcctaggcttttcttgctagaactttctttctttttttttttaactagtaactccaaattcatcaaatttgggaagatttcagcctttatttcttactaagaatgaggcatttctcttgaatgttttcctcatgttgctacaaacctttttttgtttgcttgcccttttttttttttttttttttttgagatagagtcttgccctgttgcccaggctggagtgcagaggcatgatctcagctcattgcaacctctgcctcctggttcaagcgattctcctacctcagcttcccaagtagctggggttacaggcatgcaccaccatgcctgttttctgtttgtttgttttctttgttttgttttgttttttgtatttttagtagatactggatttcactataaggctggtctcgaactcctgatctcaagtaatccacccgactcggcctcccaaagtgctgggataacaggcatgagccaccatgcctggcctgctgcaagccttttaatgtccagagctatttttaaaaagttgatttttgagttttttcccttttttcattgttttttgtggaggggtgaaatttgtatttcttcatcctccatcttcactgatgtccttccttagctgggtttctgatagggcagacaaaaatgccccaactcctaagacacttatttagttataaggatgatggttttcaaactttagtgaacacaattaactaggggagactattataaatacacattcctaggtcccaccacaaattccaatgagtttgtctgcggcctgggaacctgcattttgaaagcactggattacaagatctaaaagtaatgaacaaattgagaggttgagaggaggagaggttgtctaaatatgttaacttcacattgatttcatacaatagagccaaaagaaactacacagttgagaaatcaagatgtgggttgtatgctttagaattacgaaggcaaccactgtaagaattagaaacaaaaatagttaagacaggccaccttcagggaatggagttggagtaagacagggcaattttaaattttctttatagtttgagctttctttctcaaatacagctgttatctttataataaaacaaacacaaaaatgacaagaaaatcagtaaaaggggactattggccaacaattctgtcttcccttcccagtgcctctgccagtgtactcatccatccaccagcagctatggcccaggggcgtgcagcctggctcctcagaatggcacatggagctgggctcctcccaggagccacattccttcccacctccccccagaggcaggcatgggcaactgaatgcaaacaagatgaagaggaaggacactgtaaactaaacaattgttagcttccagacgcagccacaacctggagtcacagagccctcctggactcagggccaaaagagacctacacaaggtcacatagtgacccagtccttcccagaaccagtagtctttggagcttaaaaacataagcataggccgggcaggatgactcatgcctgtaatcccagcactttgggaggccaaggcaggcagattgcttgagctcaagagttcgagaccagcctggggaacacggtgacaccccgtctctactgaagtacaaaagaaattagccagcgtggcggcgtgtgcctgtagtcccagctactggggaggctgaggcaggagaattgcttgagccagggaggcggaggttgcagtgagccgagatcgtgccactgcactccagcctgggtgacagagtgagactctgtctttaaaaaataaaataaaataaataagcataaatctaaaacactttgcttggaagctggcctcaggcttagcttataccatgaattcatctgccaactgtttcagaggtctgggcagaagggctgcccagcaggaaccagaggtctggaacaaccaagtggggatggctgattctgagggagggatgggcatgtgacagtgtgccctctgaactgtgggggaatgtggctcccccgacccctgggctctggggggctgttttctgggtgaaggtgatccagactgttcaggccaaagccccagtgccagagactcattgtccctcccacggtggagatgttcctctctcaaggtgtcctgcattagcatgggacgttctcctccactccaccgtgcctggaatccatgtgggcaaggatgaggagggaagcagctgttagtgggaagtgaggctgtgggactccagcgttctggacagtcccagcccgaggtgacactactctgatgtgctgagtggctgacttggtagggagttagtgtttggaggttttctcacaattccatgagaatccagggcaggccatgatagtggggaaggctttcacatgacgcagcactggagctggacctgctggctgggcaagcttcagacacaggagggtggtggcatatcctttgctgtaacaggcagaaaatataatgatgtgacatgccccacctgggcccatcttgcctctggccctgcaggccttctgaaaccagctctaggaggcccagggaaccccacaggcaacaccagatttgaccccaccaaggaggccatgacaggtcccagtccacaagatgaacactatgctctttaaaaagaactcctgtcttagttggtgttagttcccagccagtgaagtcacaatgatggtagcaacaggtaccatcacctggcacctgctgagtgccaggcatggttcccagggatgcacacacacaacgctaccccgcagccccagccatccatgtacccctgtggaaaggaaggcacagagacacatcacgggacttgagagtggcagagtcaggatctaggcgggcagtcagctccagtgggggttcacagcccctcgctactctgccgttaccttcatccatgacaatgtgaccagtcatctctgcagctgcaggggccagtaaagtgcgagactcctaattccagtgcatatttgctgaatgagagaatgaaaatgtgtacccacatacctcaggtacctacaacagactgtcattataactgcaagagacagagtgaaattaatagacaccgacatgtcctcagcaattccaacaaaacaaatagtgacaagtacccaagttagtatgacctactagtctccaaatcatagtaactggtggtcaaaatgaagaggcaggacattccacaacagtgtggacgcaccaaaggaatgggcaaaaacacacacctccttcttctcaaaagtatgtgtactggttttctatggctgacatacaaattatcataaatttagcaacttaatacatcctagcactttgggaggccaaggtgggaggatcacttgagcccagcaattcgaggctgcagtgagctatggtcaagccactacactctagtctgggcgacagagtgagatgttgtctctaacaacaacaacaaagcccagttcgggtggtaaaggtggcatttcatagcgatgggatggtgcagggtgatcctggcagggcaggtgatgagagtgtggaggcagagcctgggaaacctccatgtcaatatgatcacagaaacaaggagcgctccatcgcaactggggcaaagtagaaaacgcactgagggactgacctgatgaaggtggagggtgcgaaatgcaatccaaagtaaagaagagatgagggtgcagaaaattatgggcaagaaacaatgctctcaggttctagatttgtggtcttaattgaatcacaatttggagaggcttattttgtttttatttttttgagatagtctcgctctgtcgccttggctagagtgcaatggtgccatctaagctcactgctacctctgcctccctggttcaagcaattctcctgcctcagccccctgagtagctgggattacaggcatgcatcaccacgcccagctaatttttgtatttttaatagagatggggttttactatgttggccaggctggtcttgaactcctgacctcagatgatccacccgccttggcctcccaaagtgctaggattacaggcatgaaccactgtgcctggccggagagtcttaatttataaactttaaaacttcagaacactaaaaaaaaaaattaattaaaaaaaaaaatatatatatccatttgggccacatgtggtggctcatgcctgtaattccagcactttgggaggccaaggcaggagggttgcttgagcccaggagttcgagaccagcgggggcaacatagcaagaccccatctccaccaaaaaaaaatacaaaaattagctgggcgtggtggtgtgcacctgtggtcccagctactctgggggctgaggtgggaagatcatttgagcctgggaggcagatgttgcagtgagctgtgatcgctcaacctgtcccccccacaacaaaaattttgagaatctgtctcaaaaaaaaaaaaaatttgttttgttgaaccatggtctagagaattattaatagtaaagaaaatagaagtaaaaacttatttttaataattgctcatttttgttttctaaatataactcttttatttattttatactattcatttatttatttttgagacagggtctcactctgtcacccaggctggaatgcagtggtgggatcacagctcattgcacccttgacctcctgggctcaatcgatccttctgcctcagcctcctgagtggctgggactacaggcatatgccatcacacccggctaatttttttgttttgttttttgagacagagttttgctctttttgcccaggctggagtgccatggcatgatttcggctcactgcaacctccgcctcccgggttcaagccattctactgcctcagcctccagagtagctgggattacaggcatgtgccaccacacccagctaattttgtatttttagtagagatggggtttctccatgttggtcaggctagtcttgaactcccaacctcaggtgatccgcccgcctcggcctcccaaagtgctgggattacaggcgtgagccaccacgcctggccaacacccagctaattaaaaaagaaaatttgggggatgggcacggtggctcacgcctgtaatcccagcactttgggaggccgaggcgggtggattacttgaggtcaggagttcaggaccagcctgaccaatatggtgaaaccccgcttctactaaaaatacaaaaattcgctaggcatgggggcacgcacctgtagtcctagctacttgggaggctgagacaggagaactgcttgaactggggaggtggaggttgcagtgagctgagatcgtgccactgcactccagcctgggcaacagggcgagcgagactgtctcaaaaaaaaaaaaaattttttttttgtacagatggagtctcacgaggttgcccaggctggtctcaaactcctggccacaagcaatacctcccaccttggtctcccaaagtgctgggattacaggcgtgagccaccttgcccagccaaataaactcttctaaagattgttcccaggacaagtttagggcaaatgttccacaaactactacatgtaagcacatgtgtgattacgactgaactttcacctgatttgtgaggccccaaagtagcctcagaaggaaagagccaggcccctcaaactgcggggaggtgagtattccacgctcacctgggccagctcctcctcctgcagctcaagggctcagcctggtggggtgctgttccccagggcgctaaggaggagccagtttctgtctcacatgggttgatggccatgcagcttgatttcctctctgagtcaaaggaatcttgtcagggccaggcccgcagctgccctcctgtcttggaaaactaagaactgcaccccacccctgcaagtctgtccatagccccggcaatgccacgtgctgccttccttttctgcatactggtcttggccacctgccatcaccatgtggccccagtcaccttccatcaccatgtggcttctcctatgccctggtccttgcccctgaggcatttaagcacatctccacacccgctcaacactgcagtgcagccattgctgtgtgcttctgatctcggtgagttcgcatgctcaagaagtctttggcacagagtttacgacctcaggctctccagttcaatgggcctaggttcatcccagacctgttctatttactagctaagtgcagttgtcttaacctcagtgagctcatctagttatatacagaatggtgatggcaatacctaccttataacattggactgatccacccaacaagcataccttgggcaccttccagtgttctctgtgtgggggtacagctgaactgccacagggtgacaaaggaactagagctggggttgggggtgggggctgctggggctggcccaggcaggaccttcagtgcctggctaggagccttggactctgtcctcagagcagtgggaacccaccggagggcttccgttgcagggtgggaagggtgatggggtatgccagactcatccaaacaaagccacagtctttggggagggggcagcaactggaggcagggggactgcacaggcagctatttgcaaggattctgcaggcaaaagtagtgtggggggaaattggggatgaacttgaaacttaggtgatgggtggggatgtaaattcattcaacctttatggaaaacactaggaagatttctcaaagaactgaaaatagaactaccattcgatctggcaatcccgttgctgggtatctaaaggaaaagaaatcattacgtcaaaaagacacctgtatttgtatgtttactgcagcactattcacaatagcaaagacaaagaatcagcttgagtgtccatggatggaagaatgaagaaagaaaacatggtatatatacacaatggaatactatttggacataaaaaagaataaaatcatatcttttgcagcagcatggatgaaactggaggccattatcttaagtgaaacaagctggacacagaaagacaaataccacaggttctcacttgtaagtgggagctaaataacatgtacataaggacttagagtgtgaaatgatagacaatggagactttgaagggtgaggggtgggagagaggtggctggtgagaagttacttaatgggtacagatatttgggtgttggataccctaaaagtccacacttcaccaatatacaatctatggatgtaacaaaactgcacctataccccataaattcatacaaataaaaaagaaatttaggtgataagagctatgggccttggttaccagttctgtgcatgtgcatgagtgtgtgacttgtggcatcacacggtgtcagggagccgatcggggcactgggagaggtgataaactagaatttggaaatgctgaattcgaggtgcctgtgaggtagcaagtgaggaagtccagtaggcagtgggctagacatctggaatttaggagagatcttaatggaagaaaaagatttgggaattagggttttcggggggtaattggcagagaattgagggaggagatggtgtggggtatcttcttttttttttaaatagagtcttgctctgttgcccaggctggagtgcagtggcacaatcttggctcactgtaacctctgcctcccaggttcaagcaattctctgcctcagcctcctgagtagctgagattacaggctactcgggattacaggcctggctaattttttgtatttttagtagagatggagtttcgccatcttggccaggctggtcttgaactcctgacctcataatctacccgcctcagcctcccaaagtgctgggattacaggcatgagccactgcacccggcccatatcttaattttttttttttttttttttgagacggagtctcactctgtcacccaggctggagtgcagtggcgcgatcttggctcactgcaagctctgcctcctggtttcatgccattctcctgcctcagcctcccgagtagctgggactacaggcacccaccaccatgcctgcctaattttgtgtatttttagtagagactgggtttcaccatgttagccaggatggtcttgatctcctgaccttgtgattcacccgtcttggcctcccaaagtgttgggattacaggcatgagccactgcgcccagccccatttccattcttgtttccaaaggactgtatcggctgtactatcacccctgtagggacactccctcaaacaccaaggactccttggtataacagctgcactttcagtatctgctgatcaagaaaatatataatgacaaaagtgcattataaggtcagcaatgtaggtattattttataatttttttttttttttaaagacagggtcttgtcatgtccaagctgatctcaaactcctgggctcaagtgatctgcctgcgttggcctcccaaagtgctgggattacaggcatgagccactatgccaggccaagctcagcaatatcttaagtgagtccgtattttattttttaatttttttaaatttattttatttatttaatttttgagatggagtctcgctctgtctcccaggctggagtgcagtggcgcgatctcggctcactgcaagctccacctcctgggttcacaccattctcctgcctcagcctccggagtagctgggactacaggagcccgccaccacgcccggctaattttttgtatttttagtagagacgaggtttcactgtgttagccaggatggtctcgatttcctgaccttgtgatccgcctgcctcggcctcccaaagtgctgggattataggcgtgagccaccgcacccagctgagtctgtattttattaactgcaatggcatctatatatatttggaaaatacagtactgtgtccacatgctctgtggaagctctgttatactaatttaatgataaatgcaaattactgagctatctcatctcaggaggtataaattactttctctaattgctaccttcaatgaatctctgtcaaatttcccatatttcccttaacaatactttgggcagatcccgtaagttcccaagcagttattcaaagtccagctagttcaatctcaaatacagggtaagcctttgcccactcccatcaccatgtgggtttatggcttaggactctttaagagaacaggtgggatgtgctgcctctgaattcccaccactctccttagggtctcccttctctgatgtcaggtcatggagaatgaattagggaaaacggcaaaagtctttccacgtacagggtacactggccgtatttttctcaggctaacactaatttaatttttttttaaattgaggtatactttacttacaacaaagttcaccaattttaagcacacaattcaatttttgacaaataactaccacaattatgatacaaaatattttcactgccgagcccactttgtgctccatgcagtcaatcctttcccccaacacctagcccctaagtactcatctgctttctctcaccacagtgttgcctttctagaatttcacagtatgcagcccttggtgtctggcttctcctgctgagcctgacaaatgtgagactccttcttgctgtgtgcagcagcagtctgttcctttattctgccaagtgttattccactgtatggatctacctgttccactttttgtttgtttgtttgagacggagtctcgctctgtcacccaggctggagtacagtggtgcaatcttggctcactgcaacctctgtctcctcggttcaagcgattctcttgcctcagcctcctgagtatcttggattacaggcatgcaccaccatgcccggctaatttttgtatttttagtagagacgggtttcaccatgttggtcaggctggtctcgaactcctgacctcaggtgatctgcccgccttggcctcccaaagtgctgggattacaggcatgagccactgtgcccggcctccactttttgactattattcataatgcttctatgaacattttgctataggtaagtcttgtggtgacatgtttctatgtctctgggctaagtacctagcagtaggattgctgagctgaatggttaagcggttacaacttcatgagaaattaccaaaatgttttccaaattggcctaatcattttgcattcattcctacctgctatatgtgagaattctagttgctccacatcttcatcaacacttgctactgttagtctttttaatttgggtcattcaagtggacatgtactggtttagtgatgtctcactggtggttttgtgtttctctaacaacagatgatggccaagcatccttcaggtacttatgtgtcatctgtattgtatttcttctttggtgaaatattattttgtttgtaaatcaatcaatcaatctacctatctgtctatctatctatctatctactgagacagggtctcactttgtcactcagctggagtgcagtggtgcaatcacagctcactgcaacctttacctcctggactcaggcgactctcccacttcagcctcctgagcagctgggactacaggcatgcaccaccacacctggctaacttgtttttttttttgtagagatggggttttgccatgttacccaagctggtctcaaactcctgggctcaagcgatctgcccacctcggcctcccaaaatgctaagatactgcattcagcctgtttgcaattttcttatagagccaaatgagttctttatgtattctgagtagaaatactttatgagatatgtgtttagatattctcctagtctgtagcttgtctttcattgtctaaatgaggtcttattaaaaattaattttctctgggtttattgaagtataatttacatttaataacactcaccctttttaggcagagttctgcgaattctaccactacaatcaagatatagaattttcccatcaccctcccaaaatttccctataccctcttctagtcaatcccctcccctcaaatgcaacccctggcaaccaaccactggtctaatagtgtcttttgaagtggtcaaagtttaaaatttgatgcagtatgattaatcaatttttaaaattatgtgtcttagtctgtttgtgctgctataacaaaatacctgaaactggataatttgtaaacagcaaattcatcacttacagttatagaggctgggaagtccaagatcaaggcacctgcaggtttggtgtccagtgatggctcgctctctgcttccaagatggtgccttgttgtgtcctcttgaggaaatgaacactgtgtactcacggtgaaagagatggaaaggcataaaagggctagctggttcctttgggcccttttataagggcactaatctattcatgaagttggagtcctcatgatctaatccctccctaaagtgttaaaatcaggtaacttaagttctccaactagctgtttttgatctctgtgaggccagtctgtacactaaccttttttttttttttttttttttttgagacggagtctcgctctgtcacccaggctggagtgcagtggtgtgatctcggctcactgcaacctctgcctcctgggttcaagcaattctcctgcctcagcctcctgagtagatgggattacaggcaagtgccaccacgcctggctaatttttgtatttttagtagagacggggttctaccatgttggtcaggctggtctcgaactcctgacctcgtaatctgcccgccttggcctcctgaagtgttgggattacaggcatgagccaccgcgcccagccccactgaccttctttcatggggagttcatgtaagtttttccaaaggctctgcagggtatcttcagtatagagtgttctgatatgggaaacgagctctagctcaacctccttcactcccaactccaactagctttgccatcagtgttactccctattgctgtttgctccacagcctcttgcctagtggatgtggtctggcattggacagcacaagcaatgacagggaagccccctgaagacccttgcccagaggtctctgagttttctagatttcttcaaagccaggtataaaggcagtctagcaagctcacactgtccaagcagacatccaatcagggaagatgccagcctctcttttttaggcatctgaagtcattatggtaactctctttgagctacaccctgttggctttagtaatagcaccgcaccctccctatttctgcacccaggaagctgcttagggaaactcttacccttcctcccgccccatccctcccccgttgtccagttatgtaagcctgagggtagggtggtggtggttcagaatggcagggctggctcttcagccctctaacaataagctctgggtgctgccatgttgtgctgcctttacagtgtgggatactgaatgcctctgggtactcacctttgtgccctgactcactaattccagggtaacaggaaaaggctcattaaacgtcccgttacacacagctctaataaaaacagcaataataacatcaaaacactcacatagtgcttgccaggcaccagtctctttctctacttatgttaactcatttcctcttcacaacaacccaccccattaagcaggatcagtaacccctttgcacagctgaggaaactgagacatagaggaggtaaactgcccaaggtcacagggacagagagccagagagctgcaatccaatcgagggagtttggctggagtccacgctgcgctgctttccacataggagaggcagagaaaagctgcacctgcaagagcgatggtttcggctgcgtatttggaataacgaagtcagcggtcaggagcaaggagaaggcacacatctcgggcctcatttctgtccccgagcgctcccccacactgcgagatcatggcggtggaggggagtcccgcatcctgacccccggccgccgcgcactggggggccctcaacctctgggttacttgggggcacgcagtagccacccacggggcagaaaagacgggggcggtcaactttctccactccagccgcctggggtcccgccatccctcagccaggacgcttggcagccgcctctaggctaggtggccacgagttgcgtgcgagagcgagggctgcgcatgtgcgaggcgtgcgtggtgcgtgtgtggcgccgcgggcttccgctccgacgtggggatcactagacagcaactgccccccaagttctcgtatcagctgcgggaaggagagaatggttctagtcaaccgagagtggaaggagaccaaatttcagcaaatgcacggacttgagtcctcatgagcagggtggccatggtgcggaagcagctggcacggccccctcaaccccggacccctggggtcctcactgccgacccgcgcattcagtgctgcgcataaataagatttccaattagaaggcctaggtcccagctctgccccacagcgtggctttgggccaggcacgtcatagccctggaactctttcttcccattgttgagatgaagagggtgcacgatatgttcgacgcagcaaggttaaatggaaggaaacggggcggccgcttaatgactggttgcacgcgcttgcgttgggtgctgcagcctggtgccaggaaggtggggcagggaccttgtggtgtaaggagtggcggtgaaagtgcctggggtcagagaggagaggcaggggatgagttctgagtgggaggagggggcagctcaggtttcgtcaagtagatgacctctgaaccagaacttgaaggataagacgggagatggccgagacgagagatggccctaggagcatcctggcacagcaggtgcctgaaagcctgcatagggcatagatgtgtctagagagttctgggaatgatcgctagagcggtgttgggctcgtagggaggcaagaggtgggcttggagcgggaggtgggaaaggcatggggagtgtcttgaaagcccccttcatctgcaggtcctgaaacgctgcagagggtctttaggcgtggaatttacataagatgtgtgtttcagtaaagtgacttacaggaaccagacaggaattgtaattatacaaaggggatttcggaggaaggaagttagtctcagtccagggaataatgagggcctgagctcaggagtgcagtggggagggagaaagaaggattccagagagattttgggcagagtaattgacaggctcccgattagagcagaaactaagatgatgcctaggtttggaaaactgggtgaattgaatcattaagacactgaagtgtccaccaagtgcagaccttgtgccaggcactcagcatccaaagatcaaaaaagacctagtctctgccctcaggtgcttctacttgaatagggcaggtggacacataactaggtaattgtatctataccctgtgatgttgaggattacagctgtccctgcctgacctggacctaggggtgagggcaggggggcttcctagagaagtgggacctgagcttggcagaaatgggagttcacaggcagtgtgagatgggtcccctaggtacagtaggaacgcaagcaggaaggccagggagtttgtgatgtgtttggagaactagaagcagatgctggagtgtaaaaccggagcttgacttttattctctagagggtggggagccattgcagagccttaggcagagaagggcctggtcagatttgggtttagggcagcttgccctggtgcctcgtggagaacggttgtaaaggcgagaagctaggagcgagaggtggctgtaggaagtgctggtgaaagagagtggaagctggagctgacacagggagttcaggaaggagagtgggctgggggatggtggggtggggaagtgcaggatgaggagggagggctgaggtgaggtcagtgctgcacaccaggtgcatgaggcctggggagcatctccatggaggtacctaatggcaatttactagccaagtcatcttgaccagttcacttagccttggcgatttgcctcatattgcagaatgtggatgacaagacctacctcataatgttggagtgattcactcaacgagtatttactgagtatctgttggtgttctgggtgccagggattcagctggatggcctcagcagaaaatacacaggaaatatgggttgagctaaaaatcaagggcccaattagaacagatttgactatcatccatattaacactcccagaaaagagggagatgagcagagagagagagagagagacttttccagttgcaaggcaagagtaggctgcagggtcaccttgtgctggctggcaggagccaggggctggcatgtatcctgtttggccaaaccatcattaagtggcagttcgagaataggccctctaagctcttgcactggtgtcataacatctggggatttcctgtgtgtcagtgtttgtgtggatagagggagctggtggtaagtgttcagccaggtgcatccaagatcccagggtctcatgggaggacccagggctggaactggcctcctcataccgctgtacagctctgcctggagcctggagcctcctcctctgctgagtggtgctctcagcacaaaatgagtgttatcaaaggggcatatattctgcactcactagctgcacaagagaagaacagcggttgttggtatgccttataactactcttcagaatacacacccctttgacaacattcactttgttctcaaccataaacaaccacaccccttgtttatggttgagaagatgaaggcctggtggaattagcttcttgccagagactacactgtggccagaaggactctgccttttccttggctatctgagcttcatctcagaggtgtttaattgctccagccagatccatgtgaatagcaaattaagcccacacagtggctcatgcctgtaatcccagcactttgggaggccgaggtaggcggatcacttgaggtcaggagtttgagactagcctggccaatatatgaaaccctgtctctactaaaaacacaaaaaaattagccaggtgtggtggcacacgccagtagtcccagctactgaagcggaagctacatcgagttgagatcgtgccactgcactccagcctaggtcacagagcgagactccatcttaataaataaatagcaaattaatgttttaagtgaagtaacaataacggtttactctgatttaatttacaaataaacatggagtttttgtttataaattttcaccaaatttaaaatcttcaaaggctaattaaaatagttaatatttattgagtgcttcatatgtattttctcatttgattttcacaacatccccatgagttagatatgattatcattgccattttactgaaagtaaggttggagcaaggtggagtaggatggagtaaggatgaggttaagggtggagtaaggttggtatacggtggctaaagttggggtaaggtaaaataaggttagggtaaggtgggataaggttgaggtaaggcggagtaaggttggggtaaggtgggctaagatgaagtaaggtttggcaaagttggggtaaggttggagtaagatgagtaagggggtaaggttggagtaagcttggggtaaagtgggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaaggtgggataatgctgggataagatagaacaaggttggggtaaagtggggtaaggttggggtagggtggcctacagttggagtaaggtgaggtaaagttagggtaaggctggggtaaggtggagggtaacttttcagatgtgatactgtttttgcacgccttatctttcccttcttgctgctcagttaggagcagcttttctcctcaatttaactgaagtgagcatttgctggagaagttgagggaacacgcacattgtgcagccctgtttgtctgagctgaggcttgtgtttgtcctaggaagggccatttgggagctgtttgagatggcatctcacagcgagcagaggagggcacagtcagggtggtgattggggtgaaaactctgctcatgaagaatgatttggtatgtgcacagatgatagcttttctaaatcctattttgtttttctgaaaaataagtgacagtaacctgaacacctttgagtttctccaatgctggcttagtctgaggctggggcctgcctgccatccctttccctctctcactgagtggctgctgcttgcccgtctctgacctttgagagtctcaggtctgatggtggtggagatggagcacaggtgactgattcgggggactcggagacacaccccttggaggagggacagggagggttggaggtagctggtttcatgtgggcagaacacaggacatagacatcctctgtcaacgttggtcttctctgtagtattttgtgcagggtcctggtcagtaaatctggccaagtgagtcatctgaaagcagtcatgtgatctgtgttgataagtggataaagcattggctttcatcactctctggatttgttagtgaactttaaaaaagaaacctttcttgtgcttttaaataatgactgtgttttttaatcttaccatttaaatctagttttcctgaagatgcctgtgtgcctttggccaacaggatctttgtccgaggtgacaatgaagatagtataccatgagcccatactgcctgcagagtcgtggctgccaaaattaacagctgtggaattatttgtgaccctgttaaggataaacatatttgtcccttttcattttatgatcagcaactgctaaagttcttacttgtaattgcaatttactgccctcactgtattgcttagtttagaggtggacacagaaagaatggaacatttgttttcttttgggtctgagctatgaatttgggccgcattatcatgcaggccttggcccctctgtctctgcaagattgggctttcctgtttttgtcattctcagcttacttcgcaggcatgctttgtgtagaggagaaaaataccctccaaagaacctcccaaggaggttaccaggtacacggttcagccaagtgggtgactcaatgggatgcatctctttgtgtttgtcagggccgggaagggtgtgacagcatgtggggagagactcagttcccagccaaataactttaccacctgagctatgaggcagttcctgcacatcaccactccagcagggtccagccttgctgcggcagaaagcgagtgtgtgggaaagcaaatggctccacacgacgcttgcagtgttcagagggatgagtatgaattgtgtgtatctcagggacccctttgacccatgaatacatgtatagagtattctctattatgtgggtgaagtgtatctacttacatacttaagtatttgtgagtaaaacgagaaaaaaaaaagatgtgaaggatggatagagaaaataaaacagcaggaggctggtagttcctgaggctggatgctgggcacatgggcatccattctactcttctctctatacttctgtgtatatttgaacattttcaaaataagaggttttattttgttttttgattttttttttagatggagtctcactctgtcgccaggctggagtgcagtggtatgatataggcttactgcaacctccgcctgctgggttcaagcaattctcctgcctcagcctcccaagtagctgggactacaggtgcgtgccatcatgcccaactaattttttttgtatttttagtagagacggggtgtcaccgtgttggccaggatggtctccatctcttgaccttgtgatccacccgccttggcctcccaaagtgctgggattacaggcgtgagccaccgcacctggccttttctctttctttctttttttttgagatggagtctcactctgtagcccaagctggagtgcagtggtgcgatcttggctcactgcaacctctgcctgtggggctcaagcgattttcgtgcctcagcctcctgagtagctgggactacaggtatgcgccaccacacccagctaattttttgtattttagtagagatggggtatcaccatgttgcccagggtggtctcgaactcctgagctcaggcaatccacctgccttggcctcccaaagtgctgggattataggtgtgagccactgtgcccagacagaatcaaaggattctttttttaagtatgtacagtatttgtcttagtctattgtgctgctgtaacaagatacttgagacagggtagtttataaacaacagatatttatttcttacagttctggaggctgggaagtctgagaccaaggcaccagcattcagtgtctggtgagggccttcttgctgtgtccccatggggcagaaggcagaagggcagaagggcagaaggcagaagggcaaaacctgcctcgctggttccttcaagccgttttacaaggtcactgatcctgtttatcagggctccccctgcagaacttaatcacctcctaaaggccttgtatcttaatgctgtcacattggcagttaagtttcaacacatgaattttgggggcatccaggccatgacagttttcaaacatttttctgcatatgtaggacccatcaaacgctgtactcctgctctggtgcacacactgagctgggcatctgggttcaacaatgcttcactttcctggcacgcagagctgaggggcagggacagagatgaaatctctgaggcacagtgatggtatcatggaaaccttgaactgaggggagggtcggagttggtttcactgaggaatcgaggactgagctgagaaccgaaggatgactgggaacctcctgggtgctgtgggactgggactgggggcgagggagagggagtctcagatggtgggaatcccctgtgtagtggccctggggcctgatggtggccagaggatggagcccagagggaggggaggatggtgaggcaggggtggaaggtaaggggtgttccaggcccggttaggggattggccttggtattcgtgccatggacagccattgaggcgtctaagcagggagtagccacagatcaggctcctgttttccagccaccgtttatttgtggcttggaggatggatggcacaggcaggcactggcatccaggtgagagatgacagctccccagactgaggctgttgggggtgtgtggtggcaggagtgggagcagaggtgtgtttgagagagatggaggatgtagtggcggtctaggcatgggtcatggggaggaggggtgagcataaacggtgatggagccattgcagagatagaacgccagaacaggacctgatgtggaagggaagaccaagccttgtgtctgacttgggtggatctggagggagattttgcaaagcaacttggtcatgtagacttggggctcagaggaggcccctgggaaatgagtctgagggactcctccgcatgcagacactactgagagtgtggaggagttgcttagggagaggtatgagccaagggaccacatgaggtggctccagcagactgttgagccccagctcgggtctttttaaaattaaacaagccacacttaggtgtgcttgttgtaaagatgtgaagccatagctactatatacagatgcagacacttgcagacacttttctagacagcacagctacacgtatgtacatatgcatatatattattttccgttttatgtaaatgggatcataccatcatcccagcaactcatttttttgaaggtttgttttctgattataaatgtcatgcaaaggtataatgggagtcctctcctaaaatcccattctccagagataacatcattgttaacatagtccttaaacgttttcttctatacctatatagtattttattatatggatgaatcattatttataattattcctctgtggaagaacatttaggtgcctgtaagttttcttctgttaaaatatagccctacagtgaacattcttgagtgtgtgtattcacttgtgtgcatttgtgagtagttttgcaggctgggctcctccaagtggaattgctaggctaaagggcatgtaccttttagaggtttttgtttgtttgtttgtttgtttgttttttgagatggagtcttgctgtgtcacccaagctggagtgcagtggcgcgatctcagctcactgcaacctccgcctcccgagttcaaacaattctcctgcctcagcctcccaagtagctgggattacaggcatgcgccaacaagcccaggtgattttgtagttttagtagagacagggtttcaccatgttggtcaggctggtcttgaactcctcctgacctgtagtgacccacccgccttggcctcccaaaatgttgggattacaggcatgagccaccacgcctgcccaaccttttagagttttaacagatgttgctccgtggcctgagaatgcctgtttccccacactttctccagcactagatttaacctaatctgttgggtgaaaaaggttgtcttattgatgccttaatttacattctatccatgacttgcaactttaagcatcttttaaaatgtttattggttacaggcaatcttcatgagaacattgtatcctctgtctgtttttcttttgggtttcctttatttttccttaatggagttgaaacagttctttgcaggatctggcagttgattgacagcttcttaattctaagaatgcccccaacttaaaagcagccctggagggtccccttcttccgtgtcacccccagtgtcttgtgtgagttgtcaccgggccccacttgttttcctctgaagcattctgacagctctgctcgtggcccctgcgtttaagagacatgctgggccgggcgcagtggctcacgcctgtaatcccagcactctgggaggccgagatgggtggatcacgaggtcaggagatcgagaccatcctgcctagcatggtgaaaccccatctctactaaaaatacaaaaaattggccgggcatggtggcaggcgcctgtagtcccagctcgggaggctgaggcaggagaatggtgtgaacctgggagatggaggttgcagtgagccgagactgcgccactgcactccagcctgggtgacagagagagactccgtctcaaaaaaaaaaaaaaagagacatgctgcaggccaggcatggtggctcatgcctgtagtcccaacactttgggaggccaaggcgggcggatcacttgaagtcgggagtttgagaccaccctggcaaacatggggaaaccccgtccctaccaaaaatacaaaacagctgggcgtggtgcctgtaatcccagttaactcggtaggctgaggcaggagaattgcttgaacgcaagaggtggaggttgcagtgagtcaagatcatgtcactgcactccagcctggacaagagtgagattctgtctcaaaaaaaaaaaaaaaaagagagagagagagaaacatgctgctgcagagcacccctgcagtgttcccgaggtgtgaggtgacagagccctagtctctgattctgtgacagcttcagagggtgacactctgtgtcgggcccaaaagggctcccctgggctgtcagtgatgagcttctctggtcacctttggggggtgccgtaacctcacctctgttcagtttctcagatggccagtcagggaaaagagtggccatcaacatatcatgaaaatgttctatttgaaaatgcagagtacagttcctggggacacggggatctcccagtgctcggtgcttcaagaccctgggcagttcatattagacaatgtcacaggaaggtgtgagtcattctgggcggttgctagtgtgccgtgcctgtgggcttggtgctggggaggccaggcaggcttggtggtggggaggccaggcgtgggagtgatgctcctgactatgccttctctcccagtcactcctttctgggttttgttaggggagggggtgtctagggcccaggccatcaccagaagcttggccccctgctcttgcttctgccaaacactccacagttcagctggaagcgccctcagggttgtccaagctgcctgcagttggttgtgcctccgactggctctggccccgcctcccagcctccgtagctggttcctgagccctactcctggggccgccagcctctcctacttccctcctctctctctgcttgctttgcagcagctttactgagatatgattcacataccctacaattcacccctcggaagaagagttcttagtagagttttccatcatttttagtctgttcacagagttgtgtaaccatcaccatccagtttagaatatttgcatggccccaaaagaagcccagtactcatgaatcagtcactcccatttccccctcacctacctcctctctcagcctctcccagcctctcacaaccaccagtctactttctgtccctatggatttgccctttctggacatttcatgtaagtggaatcagatggtatgtggccacttgtgtttagagtggtgagcagagcccaggctgcggcagacatccagaccaaggcggtctgggccaggtgacagcctggctagggtttggcgaggtcagttcctcctgcctccgtggggcccatgagccgcagtccccagggatgcatccggagggcatcagaggcaggacgccgagcaagctgatacccaaggagtcacagccaccctgggagcttaaagggccgatgcagggattgggaggccgtggtctgggtcagttgggaactgggggtgatcagggatggccactcatagaacctctggatcctgtaatctagagagacacggaacatgagctcccctgttggtgtctctcctgaacccattccctcaatatagacacgcttctcctttgatgttgtagacagtctgagatatattctactaattttaccagttaggctttccgtgaattgatgccttgttaaagttctctagagggttttgacattcattttcattcattcacatcttagggtgaattattttaatctaggtactttcttcctaacagaagaatcaagttaatgaaactggaagtccctagtctccttagatttcataattggcctcacaatgtcacaagaaccctgatcctggcactcgtcctatcaggtgctgtgcaagggaagcgctgtgagtgacagagcaaagccaggcatctttcagtcaaggattttctctccagttgtgtgcaagataagaagtgactgactctgtgtagccaggaggctgaggcaggaggatggcttgaggccagcggtttgggaccagcctaggcaacatagtaagactcggtctctacaaaaaatttaaaaaatatccgggtgtggtggtgcgtgcctggggtcccagctgctgggaatgctgaagcaggaggggattgcttgagcccaggagttcgaggctgcagtgagccatgattgcaccactgcactccaatctgtgtgacagatgagaccctgtctcttaaaaaaaaaaaaaaaccaaaaccaaaaacaaaaaaccacctctctagattatgttgctcctctgctccacaccatgctgtggcttctgttcacagtcaaaggtcccaaagtggccatggcctgtgctgcctgctgccgctctccacaccctggccgctcggtccccaggagaccaggcatgctcctgccacagggcctttgcactgggtgctctctgggtctggaacaggccccacacccactcacttcccccaagtctgctcagatgccacttccacacttcctaacaaaaggaagctgttggtgagcagatgctcagtaacttatgtgtggccagaaggagcgagtggctccagcctgcgcgtggaaagctggctctcctgggtcactgctctcactgagcctcgggtttctgctgcccagaggactgcgtggctctttcttgtacctggcagttctgacactgctggaattgggaagaaaagggaccctgagactaggtcactccctcctggggtctcaaggggccctgtccctggggctggaggctgagcttcctcctccttgtccccaccctggggatggcctgtgttctgtcttccttgtgctcaccactggcgcctgttggctgaggcaagagggcctccagctgggttcttcctgtcctctagttggtgcctgaaggccccagttgggtggggtctctctttaccctctggtcatatagcaaactgtggctggtgtgtggtgagtcagccctgtgtgcaggcagggtcccatttccctgtgtgcaggccacagtctgtcccagtgcctgcaaggcctctgccccagctggcctggaccccccttgccagactctgctctttgtggggctctgcccacatctactgcccagtaggacgcccagtctccactgctctttggaggtaaaagagggcctggcacactggcacggggtactttcccaaaggtcaaagatgtgttgagtgaacgaaggtagagagttcatttctgagacctttgctggcctaattcagctcagtggggtgaagttattactgttgagatgcttgctgttttgattgtctttagagagcattcttaatatttggatggtttaaaataccaaggagaaaaaagggaggagaggcttcttttttaaaaataccaacttcattatgaaaacacacaaatgtacacacaaatagaataatataatgacacccctcccaccaccacacggcctgtttcagtctgtgtccacagcgaggcttctgaaggaaaggctgtggagggggtgagctggtggagcccatgttctcccgggcctggccgggatgtgcttgccgctgtcacagctcccccatctccacccgtcacatgacatcgaatgaggccggcctggctctagccactgcacaggtgtcccgtggtcatttccttcctgtgctgctgaggcacacagtcacccgtttgcaaactctgaggtgttttcccttttcccatttcctgtcactgttttgaagctgtgagaggaagagagagacctcgatctgataaccattcatttactatcaaagttggggtcacatccttataagaacgtgtggcttgaggtcatgaatagcagtaatgcgagggaagctaagattctggcaggatgcaaatgatctgggagttttcattttgtcgttatgtatgggctgttttctgctgcattgttaactattggaaaagattttccatggattattatatggattatagaggaaaatgcaaatctccaacctctatacatttaatcacttaaatgaaatgtcaagttttcttgttaagaattatggtgctgactggaagaacaacatggctttaaatatgacttattagtttctttccacttctaaagttcaaaataaaacatcataggtggcaaaacaaatcaaggtaaaatacgttttgaaaagtcataactttactcaacaacaaaaaataagaaatagacagaggacttgaatagacatttctccaaagaagacatacaagtggccaagaagtacatgaaaagatgcccaacatcactggttattagggaaatgcaaatcacaggcattaggatggctattatcaaaaaaagccaagcaaaaccaacaacagaaaataaaagcattggcaaggatgtaaagaacgtgaagatgtggagaaattgaacgttggtttactgttggtgggaatgtaaaatggtgctgccaccgtggaaaagtttggtatttcctcaaaaagtgaatcagaggccaggcgcggtggctcacgcctgtaatcccagcactttgggaggccgaggtgggcagatcacgaggtccggagatcaagaccatcctggctaacacggtgaaaccccatttctactaaaaataaaaaaattagctgggcgtggtggtgggcgcctgtagtcccagctactcgggaggctgaggcaggagaatggcgtgaacccgggaggtggagtttgcagtgagccgagatagcgccactgcagtccagcctgggctaaagagcaagactccgtctcaaaaaaaaaaaaaaaaaaagtgaatcagaattaccgtgtggtctaggaattccacgcccagaataggcatgcactgaaaagaattgaaagcagggactcaagacacttgtgcatcgatgttcacagcagcatcattcacgctagctaaaaggtagaaacaattcaaacatgcaccgacagataaatggataagcaatgtggtctacagacatggacaatggaatattatccagccttaaagaaggaactctggccggtcacggtggctcatgtgtgtaatcccagcactttgggaggccgaggcgggtggatcacgaggtcaggagttcaagaccagcctggccaagatggtgaaaccctgtctctactaaaaatacaaaaattagctgggtgtggtggcaggtgcctgtaatcccagctactcaggaggctgaggcagagaattgcttgaacccaggaggcagaggttgcagcaagccaagatcatgctactgcactccagcctgggtgacagagcaagattctgtctcaaaaaaaaaaaaagaagaaggaattctgacacatgttactacatggatgaatgttgaagccatgcccggtgaaataagccagtcacaaaaagacaaatattgtctgatttcacttatatgaggtatctcttatataaggtaatcaaattcatagagacagaaattagaatagtggttaccagagggtggggaagcagggaatgggaagttattattgaattagtatagacttacagtttgggatgacaacaaagttctggagatggatgatactgatggttgtacaacattgtgaatgtgcttactgccacagaactgtacaattaaaatgattaaaatgatccttttggccaggcgcggtggctcatgcctgtaatcccagaactttaggaggccgaggcagatggatcgcgaggtcaagagatcaagaccagcctggccaacatggtgaaccccatctctactaaacatacaaaaattagctgggcatggtggcacgtgcctgtaatccccgctactcgggggctgaggcaggaaaatcgcttgaaccagggagtcggaggttgcggtgagccgagatggcaccactgcactccagcctggtgacagagtgagactccgtctcaaaaaaaaggatccttttgtgctgtgtatattttaccacaattaaaaatgcaggagttagtaaaggaatggaacaagatcatgtgaacgtgagttatgagaatactggaatggcatccggcaaagcagactcagaacaggactgttcctagagatagggaggactgttttatgcggataaagtggtcaagtcatcaagaagacattatgatcctaaatatgtatgcacccaatacagagcaaaaactgacagaaccaagagaacaaatagacaaatgcgcagttatagctagagatttccacacttctctctcagtaaatgacagaacaaggaggcagaaaatcagtttaagaatgcagaatactgcctgggtgcggtggctcacacctgtaatcccagcactttgggaggccaaggtaggcagatcacttgaggtcaggagtttgagatcagcttggccaacatggcaaaaacctgtctctaccaaaaatacaaaaattagcaaggtgtggtggtgcatacctgtaatcccggctacttggtaggctaaagcagaagaattgcttgaacccgggaggtggatgttgtagtaagccgagatcacgccattgcactctagcctgggcgacaagaacaaaactccatcatgacaaaaaaaaaaaaacaacaacaacgacaaaaactagccaattgagttgggcacagtggctcacgactgtaatcccagcactttgggaggccgaggcaggcagatcgcttgagctcaggagatgaagaccagcctgggcaacgtggtgaaaccctgactctacaaaaaatccaaaaaattagccatgtgtggtggtgtacacctgtggtcccagctgcttgggaggctgaggtgggaggatcactgaagcctgggaggtcaaggctgcagtgagcagagatcgcgtcactgcactccagcatgggtgtcagagtgagaccctgtctgaaaaaaaaaaaagtcagttgaatctagcaacaaaaaaaaggataggccatggacaagtagagtttatcccagtaatgcaacatcagcttaacatttaaaaatcaatataatcctccatattaacacaaaaaaagtaggaaaacactatcaataaagagcagaaaactgatggtacaacaagtggatgaatctcacaggacttatgttgaatgaaagaagctggacaaaacagtatgcactgtgattccttttatagaaaactctagaaaggacagatctcatctagaatgatggaacacagatgggtggttccctgggtcctggtgtgaccaggaggagtcatgagggaagcttctggagtgatgggatgttcttggttttgactgtgatgatggttacttacacaggtatacacatttgtctacatgcattgagctgtatacttttatttttttttttgagacagagtctcactctgtcacccaggatggagtgcagtggcacgtcttggctcactgcaagctccgcctcccgggttcacgccattctcctgcctgaggctcccaaatagctgggactacaggcatgggccaccacacccggctaattttgtttttgtatttttagtagagacggggtttcaccatgttagccaggatggtctcgatctcctgacctcatgatctgcccacctcggcctcccaaagtgctgggattacaggcgtgagccaccatgcccggcctaagctgtatacttaagatgtgtgcactctctcgtatgcaagctgtacatcaataatattgatttttaaaaatcctttaactgaggtaaaacactgatgtacagtgtagttattctgcattttctgaaataaccatagtttatatcagaaagaatagggagctacagaagatacagaatagtgcatataagttgctactttttattgataaatttttacatgtttatgtggtacatggagtagttgttacattacacattacagaatatgtaatgatcaactgagagtatctgaggtatccatcaccttgagtgtttctttcttttttcttttttttttttttttgagagggagtcttgctctgtcacccaggctggagtgcagtggcacgatcttggctcaatgcaagctctgcctcccgggttcacgccattctcctgcctcagcctcccgagtagctgggactacaggcgcccgccaccacgcccggctaatttttttttttttttttgtattttttagtagagacggggtttcactgtgttaaccaggatggtgttgatctcctgacctcgtgatctgcctgcctcggcctcccaaagtgctgggattacaggtgtgagccaccgtgcccggccttgagtatttatttctaagtgtttgtaatgaggtaggaggcaggcgagactcaactccggaccagattgaggactggccaaaactaggaagaagtgcacaaaggacctctccataagacatgcccaccagtgccatgacagtttactattgccatagcaacacccaaaacttaccacccattttctagctgtttctgaataacctgccccttaattagcatggcactaaaagtgggtataagatatgactgcaaaactgcccctaggctgcgaccctcagcacactgcctatggggtagctctgctctgcaggggcagccagccagagctatagcactgcctccaccgcaagaaagctgttttcttccactaccagcttgctcttgaattccttcctgaggaagccaagaacctgccctgcatcagtagcatttcaagtcctctcttctagctgctctgaaatatgcaatacattgttgccagctacagataccctactaccctgctatggaatgttagggcttatttcttctacctaaccatatgtttgtacccattagccaacttctctttatcctcctcccacccacacatgcttcccagcctctggtatctatcattctattctctccctccatgacatcaactttttagctcccacatatgagtgagaacatatggtagctgtctttctgtgcttggcctatttcacttaacgttatgatcatcggttccatccatgctgctgcaaatgacgatttcattcatcttatggctgaatagaattccattatatatatatttatatatatatatatatatatatatatatatctatctcacattttctttatttcttcatctgtcagtggacacagtttgattccatatctttgctgttgtgaataggagagtgctaccactgttaaaggatctatttacatacatgcttataaataaatgcatccaggatttttgtaaagatctatcattactttcactcttttgtagcttttgaattttttcatcatgtgcatccacttcctaaaaacaaaatttctttttttaacttttcttttctttttctttttttttgaggcagggtctcattctgtcacccaggctggattgcagtggtgtgacctgagctcactgcaacacgtacctcctgggctcaaacaatcctcctacctcagcctcctgagtagctgagactacacactcatgccaccacacccagctaatttttgtattttttgtagagatggggttttgttatgttgccaagactgctgtctaactcctgggcacaagcaatctgcctgccttggcccaaagtgctgggattacaggcatgagccaccgcacccagttgtgtttttttgtgttttgtttttgtttttgtttttgttttgagacagagtctccctctattgcccaggctggagtgcagtggtgctgaaacaggaaaagttcccgtgtccccctcgcagggcaggcgatgggggtgtggttcgcttcttcagtgccccactgctcaaaccgctaggggagcatacagatgggcaggctgtggggctccggccccagggcaatgtctaggggttaatgtttacagccaggacccagtgggcatgtgctactgtttgctcttttagttttgctgtctataggtggcttttgttaaccagttcaattagaccctctaggcctggcatggtggctcatgcctgtaatcccagcactttgggaggccgaggtgggcagatcacttgaggtcagaagttcaagaccagcctggcccaacatggcgaaaccccgtctctacttaaaaatacaaaaattatccgggtgtggtggctcacacctgtaatcccacctattcgggaggctgaggcatgagaatcacttgaaccccagaggcagaggttgcagtgagcagagattgcaccactgcactccagcctaggcgacacagggagacaccatctcaacaaaaaacaaaaaaaaaaaacaaaaacaaaaacagaaaaaaaggaccctgtaccttgttgcgaggacagaggacttcctgtatccgggtttttgacttggtgtaccggaagaattggatcacacgtgggcttggagaatgagtgcaaggttttgttgagtggaagtagctctcagtagatgggggagccagaagggagatggagtgggaaggtggctttcccctggagtcgggtcgctcagcagcccaggctctcctcgactgccctggccaaactccacgtcgttccaccagtcgagagcctgccagtgtctgccagtgtgctcttctgccagagtgctcctttcaacatcctctcaaagtccagcggcttgcgtctccttctgccagtgtgttcctcatgatgtccagccacttctgtgtctgcctgctagggtcttgggggttttcataggcacatcatggggatgcagcaggccagggcattctgggtaaatgcaatgtttgggcaggagtgcctatcctcacctaggtacatagtggtggagctctagccagggaccatgccctcctctacccagcacttctcttccccactcctgtatcatttaaagggaccacgctgttcccttcccagcacttcccttccatatcagcgctatcattagctccctgcagccacaaactcctgggctcaagtgatcctcctgcctctgcctcccaagtagccaggactaaaggcatgtgtcaccatgcctggctaatttttttaaaaagttttgtagagatagggtcttgctatgttgcccaggctgaattaactggactattgttcaggaaaccaaagtaccaggcagtacaatgctagatttgaagtctatgaaaatagtaccctctgaatcattaaggcgcatcttcctatgagaggtggcttgagccagaccctggtggccaggggcagtgtctgtctggaccttcccaccaacaggctgtgcagccctggccagcccctattgctcctgtactctttccttacctgctaaacacacccaaatcacagcagaaatccaattcacttgaagacaagggctaagcctttctcataaccaaaggccgtgcgcttcccagagcaaaagtctgtatttgtcccctcatgttctgagctgccaggcagtaattctagcctacagttactcagtgtgacctaaaataacaattacccaagaaatgaaattctgataatttcaagtagaataaaatggaacatattttagtgaatggattgtaaggaaaagcctaaagatttggaactgcccatacgtggcactttaaaaatcttgggccctttatttcaggtaatcagttcatagagtaaaaacccatgtgactgccaagactggttattagttcaagcccaagaacacatcttcaaaggaagagaatgaatttatccacagttctgattgttttttacgttctaaaatcacacttattattaaaatataattcacttaatggtgatggtaattacatcagccaattcacttaaaatgaatgcgcaaagatgaatgcacaaaaatgcaccatttttcaatgaattggctgatgtacttaccgtcaccatcaaaacgcagggtgttcccctttccccgggaagcttccttgtgctgcagtctctgtcaaatcccttattcacagacctggccaaacactggtcactagagattagatttagctttcagggtttcacagaagtggaatcattcactctatgctgcttcttgtctggtacctttcgctcagcacaatgtttttcagctttatctgtgttgttacatgtgccaaacctttattcctttgtcgttgttgttttgaaacagtcttgcttcgttgcccaggctggagtgcatcggtgccattgtagctcactgcagccctgaactcctgggctcaaattatcctcccgcctcagcctcccaagtagctgggatgacaggtgtgtgccactgtgccctactaattttttatttttattttattttattttattttgagacagagtctcgctctgtcgcccaggctgagtgcagtggcgcaatcttggctcattgcaagctccgccttctgggtctacgccattctcctgcctcagcctcccgagtagctgggactacaggcgcccgccaccacaccaggctaattttttgtatttttagtagagacggggtttcaccatgttagccaggatggtctcgatctcctgacctcatgatccacccgcctcggcctcccaaagtgctgggattacaggtgtgagtcaccacgcccagcccattttaattttttttagagatggggtcttaactatgttgcccaggctggtgttgaactcccggcctcaagtgatcctcccaccttcgtctcccaaagtgatgggattacaggtgtgagccactgcacccggccacatttattccttttgatcgctgaacagtactcctcaaatgattttttaaaaataactatcttcttcctcatgacctgctggtaactcctagaacagtgatggaggagaattatggaatggtccttctaagctcctgaataattaaaccagtgagcagagccactgtcccatcccgttggccacaccagacacttgggaattatttttggttccttcttctacctcttttcaattccaataattaccaagttctatcaattttaatcccctaatatctctctaatcgatctcttcagttgctatttaagtaactcttcatttcttctcacctgtgttactacagaaattcatttttctatagttttgccttccatcaatcccttctccatcttaaaccaaactgatcttactgagaggaatgttgtgatttcctctctctctctctctctggaatgaatatatacatacatacatatatatatatatatatatgtgtgtgtatatatatatatatatatgtgtgtgtgtgtatatatatatatatatatatgtgtgtgtgtgtatatatatgtatatatattccagaaccttttcatcaccctaaagagaaactctgtccctaaatcccattccccctcccctagcccctggtaaccaccaaccaccatctcactttcgctctacaaatttgattattctaggtaccccatataacgactcgtacggtatttgtccttttgtgtctggcttatgtcacttagcccaatatttttcaggtttatctatgttgtgtcatgtgtcagtatcaggatttcatctctttctgaggctgaatgatgccccactgtgtttatccattcatctgttggacacctgggctgcttctatctcttgctattgtgaagaatgctgctgtgaacatgggcgcacaagcttctgttccagttcctgctttaattatctagggcatacacttaggactgggattgatggctcatatggtaattctgtgttcaaatttttgagaaaccacctaactgttttccacagcggctgcaccattttgcattcccacaagcaatgcgcaaaggttccattttctccaaaactggatacagtgaacaacaatgaaggtttttggttttaaacatatatacatatgttgtttatatgctctacacacatctctgtgtgtgtatcttaaaatgggtgccagtgactcgccattcagttttgggcaacgtggactctcggtgcctcagtttcctcacccctaatggaggtactgatactgttatcattcttgaagtgattgtgcagtttaaatgagcaaatatatgtaaatgacttaagtgggacctgacaaatgcagatgctataatgtaaggatggctgatctcattattgttgtcatactattactgaaaatcagtgtgaatgaaatctctaaactttgcaatcaacactgctcacctgggtctccgtagaagctgcagcgagctggggctgaggcagacaagcctgtggacatgagaacagatgcatgtgctcctcagacagacagacagtagggtgttgtggaaggggtcatctttagaggccacatactgtagtccatctccctcacagagcaggaaggtgaagcttgccaagcctgagggaatcctccagcccagacatcctatgagggcattgccaggacttgggggtagtgccctcgctccaggcatgtcttttccccatcccttgagcaggaagaagcacagcagacagcagggtgcatgcagagtacctggcagaatcgcctcggtagtgagaacaagcctgcgtgatgctgcaggtgcccctgactgtgactgagcctggcttcacacacctgggtttcctcatggctgttttcagcaatttggttactgtggtcccaggatgcatagcctctcaagattccacagaacagcctggtccagcatgaaggctacacggtgcctggtgccatctctcaacgtgtttgttaaaagggaagctttgtggcctcttcatctaatatagagggccttcaaattatagacttccaagtccatagctatagagattttcattttaaaatatatgtattggctgggcataatggcttacgcccgtaatcacagcactttaggaggccaaggcgggaggatcacttgaggccaggagttcaagaccagcctgggcaacagagtgagaccctgtttctcctaaaataaaaattaaaaaattagctaaggatggtggcatgcacctgtagttccagctacttgggaggctgaagtgggaggatcatttgagccaaggagtttgaggctgcagtgagctgtgatttcacactgcactccagcatgggtgacagagcaagactctatctctaaaaacaaaacaaaataaataaaatacagtaaaaaatagtgtgttgtgttgtggggtctgatgcggatgtctacagctcttcattcctaatgcatctgctgtttttccagctccccctgaggccacgggccacacaggccacaggggctctgcctgcccagctgggtccacaggaattctgccaagaagggctttcttttgcccttgtgggagctggtgggtcacttcctggtttttttctcatgattattgtttgtgaagtttgaatagaactgactcctggcttgttttttaattattaaagatttaagaacttttgaaaagattaaaaaagaattttgctcatattcctgccagccttgcataataattgttttcatttctatagacttttttctggtcttttctcatgctgacacagattttacattgttgtaatcattgtgtggggacaatttaggttctttcttctcagttttgtttgtaaacatctctttcatatcacattatttattattattattatttgagacagggtctcactctgtcacccaggctgcagtgcagtggtacaatcatagctcactgcagcctcaacctcccaggctcaagccatccttctgcctcagctccctgagtagctgggaccacaggtgtgtaccatcatgctcggctaatttttacattttttgtagagatggagtctcgctatgttgcccagactggtcttgaactcttggcctcaagggaccctcctgcctcagcttccacagtcctgggattatagacatgagccactgtgcccacattatttatttttgacagccaaatagtaatctgtcaggttaacatactgtaatatattatagagaagagacattcctctctgactggtatttaattttacccaaattttcactatcgtgaattttgtttaactcttcttggttttatgcaatttgtaaaaaatcactgttcataatttgtcttccatgcagttcatgccacagcatttgagagtgggtgctgccctcctccaccgtccctcttctatcagaattccgccacaagaaatgtcctggcattaacattttggaagctgctttagtgagggccactcttggggctggacaaatggctacttgagggtggtatctgccatgaggttggtcaggtacaggggcttggctggcctggcctggtgtggactattccaaggtcacgtcatcaacaacaaggtgggttagctatggtgcacatactccgctaccctaagcagctggaaacctggacaaaatgtctgaatcaactgttttcaggtgttgagaaacaggccatgcagagctgtgaccccagagtctacagaaatgagatggcaaggcgccgcagctgccctgggtttctgccttggtggggtcgggggtgcttcatgcacatcaagcagtgcgagtggcttggctgcattgaggagcggagatggggggctctgaacagctgtggtttgtgggctgagtcctggagggatgggaacactgcagagagggggctccagtaatcctcagggttgccccgagcattgggagatcctaagctgtgtgtgtgcggtgtgcaacgtcgtggagacaggaaagaacgagtgaccaggagcagaaaggcagctgagtccaagagttcacctgttctgggagatgctcgggtggcagccagactcagtggatggctctcactgaactcccgggatgccctagagacccctgaagagccccaccttagtagtggagcaaataagctctagagtaagggtgtcttagaccctcccctgcagagcttaaaacaaggcttcaaagtgaggttggaggcgggccccaatctggaggcttggctcatgcaagggaccaaattgaggcctagctaaacagggagggggcagaagcagctttccctaagatacacccaccagtgtgccatgtcagtttaccattgccatggcaacacccagaattgacctctcctttccatggcaatgaccggacaacccaggagttcctactgcttccctagaaatttctgcataaaccactcgttaatctgcatgtaattaaaagtaggtataagtatgcctgcaaagctgccctgagctgctactctctgcctatggggtccccctgctctgcaggagcagtcacggagctgcaacactgctgcttcagtaaaagctgtttctcctaccaccagcttgctcttgaattctttcctgggtgaggccaagaactcttgagggctaagccccactttagggctcatctgccctgcctcaaaaaaatcaaactagtctgccagtgactttgctgcttaaccaggcttggaagaaaagaaaactatagatcaaggtccttcatgaacacaaatgtgaaaatcttcaacaaaatattaccaaatatgactcagccatgtacaaaaaggattatacaccataatcaagtagagtgtatcccaggagtaaatggttagttcaacattcgaaagtcaatcaacacaattcttcctatcagccaactcaagaaggaagcatttatgatcggctcaatagatccagaaacggcatttaacaacatccaacacccatgtgtgaccaaaacacaggaagccgggaattaaagggaatttccttaatgtgataaaggcatctacaaatgccctacaactagcagcatgcctaagggtgaaagaccgaatacttttcccctaagggccagagcaaggccaggttgtctgaccccatcatttctattcaccattgtactggaggttgtagcaagggcaaaaggtgagaaaaaggaaaggcatacagattggagaggaataaacaaaaccatctttattcccagatgataggattttcagtgtagaaaatccgatggaatctacagaaaagctaccgaaactcacaaggaaatatatctactagcaaaccactgaaaattgaaataaacatgtccatttatgacagcaccaaaacacaaatttggtcatgaatcctataaaatatatgcaagagctacatgctgaaaacaataaaacttggccggtgcagtggcttatgcctgtgatcccagcactgtgagaggctgaggcaggaggattacttgaacccaggagttcaagaccagcctgggcagcatagcaggagcccatctttataccaacaaggaagaaagaggccaggcacagtggctcacacctgtaatcccagcactttgggaggccgaggcgggcggatcacttgaggtcaggagttcaagaccaacctggccaatatggtgaaaccccatctctacaaaaatacaaaaattagcagggcatgatggccggtgcctgtaatcccagctactcagaaggctgagacaagagcatcgcttgaatccaggaggtggaggttgcaatgagctgagatcgcaccattgcactccagcctgggtgacagagcgagactctgtctcaaaaaaaaaaaaaaagaagaaagaaaaagatatataaaaagctataaaatgctgataaaaaaatcaaagaattcctaaataaatggagaggtatattgtgttcttgtgttggaatagtcaatattccaaggtttacaagatgtcagttctcccacactgatctagaaattaaactaagtcccagtgaaaatctctgcaggttttttggtagaaatcgacaagcggactctaaaattcacagagaaaggcaggaagctaccatagacactactctagagaagaatatggttggaggacacacactatctgatttgaagacttactacaaagctacggtcatacagacatggtggtgttggagaaggcatagacagatagatcaatggacagacaggcaggccacagaaatcgccccacatggctgtggtagattgccttttgacagtgtgaggccagtttagtggaggatggattgtttcgggatgaagttcttggttcagagggtctgagactcaaggaggagttctggagcccagagacaccgttttgggaggtgtagacttagagttggaatggaggacgtaggaagatgtgagcttccccagggagatgggaagatggaggagaaagctggggtcctgactctggaataggagagagacaggattaagagagggacctaaaggcggggaagctcacgtctgcacaatggggaacgtatctggggaaggagctggcacatgctgtcaggtgcttctttgagcacaagatggcccaggccggaaaagggatttcagggaggtaaagaaatgcagaagaatgggagagcagggtggagacacaatggtgctgcacatcagcctggtgtcaccctctgctgcacatggagggatgggggtcatgccaacaaacagccatacagttttccttcttagctgcttgttttttttgagacatggtctggctttgttgcccaggccggagtgcagtggcacaatcttggctcactgcagtctcaatctcccgagctcaagcagtcctcccacctcagcctcccaggtatttgggatcataggcatgcaccaccatgcctggctaatttttaaaattttttgtagagacagggtctcactatcttgcccaggctggtgttgaactactgggcctaagtgatcctcctgtctcagcctcccaaatcatgctgagattacaggcatgagctaccaggcccggcctctcaactcttttttttttttttttttgagacagagtctcgctctgttgcccaggctagagtgcagtggcacaatctcggcgcactgcaagctccacctcccgggttcacgccatcctcctgcctcagcctcctgagtagctgggactacaggcgcccgtcaccatgcctggctaattttttttgtatttttagtagagacggggtatcactgtcttagccaggatggtctcgatttcctgacctcgtaatccgcccacctcagcctcccaaactgctgggattacaggcttgagctaccgcgcccggcctcaactctttaaagtaagatctatcatccccattttacggacaggggaactgaggctgggttcctgccgccagcgagtgggacccctggcctttgagccccggcccttcccaccaccctctgctgctggggctcagccctcgggcacgtggttgtgttaatggagagccatggccatgacttggagggcccggagagcgtgcacatcatgcctgcttcccatgatgccctgcgaggtgggcagaggccgggggtgctcaggccgagcccctgctacagcagatctgaggcaccagcagggactggctaggtcctcccaggcaggccaatgtgcccgggtcttgggcctctctctctcactcctcactgcctctcagctgcccaggcagcgtcccctgcagagcagccctggagcctggccccaggctgtgttgctgcctcttgcccccatggggctgcctctgcagggagcctgagtcgtttcctccctgggcaggtttcaaaatggctaagtccagtggagaaaagaatggctcaaagggaccacaggcttgaatttgaaaaaataaaaatgctcgatgccaaagcgtagacgcacatttatttgaacgacttacactttgacctgaaacagttttttccaaattgttttccacagcggtaatctcttcaaaatgaacacatgtgaggtcttcgaatgtatgttaaaggccagtatttgtttttttttttttttttttttttgctttggaagaaccgacctcatcgtttgcatgagaacctgatattcttggtcctctgtaccttttgtaacttcctctgaatgagaggaaatatggtttccagttatgtttaatttactttaaacaaatcaaagcacagatttctacttcctgcctgtgtaatacttgactgcaggcagcttcaaagggcagaatcactgttcttgtgactgtgcctctgtcgtgttctgttataaacagttcaaagctctgcattgtacaggagcgcgcggaacagcatgtagagatctttttctctgtagtggcggcagagctgtgtgtgcccttttgctttgccttgtgctggtggtggattaagtttaggttttcatagaatatatatttatgtagagactcagagtttatttttcctgttttctccagcactgcttaactcattctctgaaatgtttatcacaaatggcaggtggggctcagaggatgtctctatctttgttccttggcttaaactggcaggttgttgtaaagggcagtgggagggaaagaaaactaaggggaaaccaaattacttatttagggcttgattttctggcaggtgaattgggcttaggaaaccccacctagattagcagctgttcctgaccggcccctcgccaaagctgcacccctgggtggtggtgggggcttcaaattagggtgtcccaagggctggattgttccagcaaaggtgttcctggattcccaaagcaagttcacttgttttaggaacagttccctgaggctctgcaggggctgctgggctgccttgtctccccaggtccatgacgccaggccaccatccatgcatcctgttgtgtgctgggacggggtgccagatgctggcatccaggaacagagagtggattgcatgaacatggctaccatgcagttggttctctgctgctggggtgcaggcacctgaaagacacggaggagctaacccagctgagaagggtgtgtgccagtcaggacctggggtgcaggacacaaacatcacaccactgggttgcacaagacttggaggaggggcccaggaggatgacatcaaggtctggagggggttgctcaacaacacacctggatgtgcagtgcaggcatggcacctgcctctgcagcagggcccaaagactcgatggggctgccatgtggcctgatgtgagttggagtgaggctgtgacccccgggtgaaagctgcagcctgcatgcatcgatcacaagcgagggctggctgtgtcctcatcccaggaagggcggggtgagggcctcaccacagtgtgggcagggcccactcacgccctgggaagtgaatcaggaggtggcagcaggcactggggctctctaatctcttgcccgtctttgtccagttattgtgagagctccaattccctgttcttatttttctgaaagtgctgataagatgggtacagaataaatcaaatgcaaagttacgtttcctggcttaggaagcaaaaacctaagtataaccttggaagtgctcctgggtactcctttctttccccaaggtgatttttccctcttaaacacattacagtaaaatacatacaacattcactactttaatcatgttttgtttgtttgtttgtttgtttgtttgagacagggtctcgctttgttgcccaggctggagtgcagtggagcaagcacagctcgccttctgggctcaagtgatcctcccaagtagctgagactacaggtgtgagccacagtacctgactgattttgaaaaaaaattgtttgtagagatagggtctggctatgttgcccaggctagtccaaacttctgacctcaaactatcctccaggctgggactcccaaagtgctggaattacacacgtgagccactgtgcctggcccactttaattttttttttttttgagatggagactctgtcacccaggctggtgtgcagtggcacaatctcgactcactgcaatctccacctcccgggttcaagtgattctcctacctcagcttccctagtagctgggactataggcatgcgccccatgcttggctgattttttttgtattttttagtaccaacaccatgttggccaggctgttcttgaacttctgacttcaagtgatccacacatctcggtctcctaaagttctggaattacaggtgtgagccaccgcacctggccccactttaaccatttttaagtgcattaaggacattcacagtgttgagcagccagcaccatcaccatctccagaacgtcgtcatcttccgaggctgaaactctgttcccattgaacaccacctccccactccccatggctgtctcaggagctggcctgagcactgctgccctcaaggtcactctagaagtggagcttcagttcggcccccacttcctgtggctctatccctgcaggtgtgcccgggatccagaggtggccccatgaggccttgtccgagcaggtctggctggacccttgctcctcttggagctgggtagggctgggtgggctgcgtagggatgttcagggcagtggtcacctgttgcccagctctgggtggagccctgtctgaagacagctgttcttttctaaagaaagaagatctgtcagacgttagtcatctgcaccactgtcacagctgacgttgattgagctcctgtgtcctgggcactgtcccaaaagccccctgcatgcagttcttgccatttagtaccttttgttttgtgtttactgaatggatacagccggaagctagctaaatttaactcacgccctcgacttgggtggaggtgaggaaggggctttctgaggcagggaattgggtgagggctttattttataggcatactttggagatagtgtgagttcagttccagaccacactgcagtaaagtgaatatcataatgaagtgggtcatatgaattttttggtttcccagcacatataaaagttatgtttacactaaactgtagtctattaaatataggatagcatcacatctaaaaaaaacaatttttatatgccttcatttaaaaatacttggccgagcgtggtggctcatgcctgtaatcccagcattttgggaggttgaggcgggaggatcatgacctcaggaattcaagaccagcctggtcaatatggtgaaaccccgtctctactaaaaatacaaaaaaaaaaaattagctgggcatggtgtcgcgcgcctgtaatcccagctactcaggaggctaaggcagaagaatctcttgaacccaggagacggaggtggtagtgagccgagatcacgccattgcactccagactggatgacagagcgagactccgtctaaaaaaaaaaaaaaaagaaagaaaaagaaaaaaaaactttactgctaaaaatactaatgatcatccaagtcttcagtgagtcagaatctttttgctggtggagggccttgcctcggtgctgatggctgctgactgatcagggtggtggttgctgaagggtagaggggctgtgacaatgtattcaaatcagacaacagtgaagtttaccacattgattgactctgcctttcacaggagatggcccccggcactggaggctgcttgataccattttacccacagtagaaggtctttcaaaattagaaatcctctcaagcctgctgtgttttttcggttatgaaatattctgaacgctttgttgtcattgcaaccatgttcacagcatctgccccaggaggacgttccgtctcaaggaaccactttctttgttcatccctaagaagcaactcctcatgtgttcaagttggatcctgagattgcagcaattcagccccttcttcgggctccacttcttttttttttttgagacggagtctcgctctgtcgcccaggctggagtgcagtggtgcaatcttggctcactgcaagctccgcctcccgggttcacgccatcctcctccctcagcctcctgagtagctgggactacaggcgcccgccatcacgcccagctaattttttgtatttttagtagagatggggtttcaccgtgttagccaggatggtctcgaactcctgacctcgtgatccacccacctcggactcccaaagtgctgggattaccagtgtgagccactgcacctggtctaggctccacttctaaatctggttctcctgctgtttcccccacatctgcagtgactttctccactgaagtcctgaaccctcaaagtcatccatgagggttggaatctacttcttccaaactcctattaatgttgatattttgacctcttcccatgaagcaaaaatgttctcttttttttgagacagggtctcactcgttgcccagtctggagtgcagtgatgtgatcgcgaggacatcaacaaccttctgggctcaggtgagccctgcctcagcctcccaattagctggaactataggcatgcaccaccaaacctggctagtttttttttttgtttgttttgttttttttttttataaacagagtctccatatgttgccctggctggtctcaaactcctggactcaagtgattcttctgcctcagcctcccaaattgttggaattaacaggtgtaagtcaccacaacttgctgcttttcatggcatctagactggtgaatcttttccaaaagattttcaatgtacttcgcccgaatccatcagaggaatcaccatctatggcaactatagccttatgaaatgtatttcttgaataataagacttgaaattgaaattactcttcagtccatgggctgcggaatggatgttgtgttagcaggcatgcacacagctttcatctccttgtccatctccatcacagctcctggatgactaggtgcagtaatattttgaaaggattctttttttttttctgagcagcatttctcaacagtgggcttaaaatattcagtaagccctgctgtaaacaaatgtgctgtcatctaggttttcttgttccatttctagagcgcaggcagagaaaatttggcatgattcttaaggccctaggatttctggaatggcgaataaacattggcttcaacataaagtcaccagctgcattagcccctaacagagccagcctttcctttgaaactttgaagccagtcattgacttctcctctctagctaggaaagtcctagatggcatcctcttctgatagaaggctgtttcacctacattgacgatctgttgtttagtgtggccaccttcatcagtgatcttagccagatcttctggataacttgcggcagcttctacatcagcacttgctccttcaccttgcacttttatgttatgtagatggcttccttccttaccctcatgcacaaatctctactagcttctaagttttcttctgcagcttcctcacctctctcagccttcatagaattgaagagaagtaggatcttgctctgaattaggctttgacttaaggaaatgcatggctggtttgatcttctatccagaccactaccacattctccatatcagcaataaggctgtttcactttcttatcatttgtgtcttcactggaggagcacttttaatctccttcaggaactttacctttgcattcacaatttgattatttggtgcaagaggtctagctttcagcctgtctcaacttttgacagccttcctcactaagcttaatcatttctaacttttgacttaaagtgagaaatgtgcaacccttcctttcacttgaacacttagaggccattgtagggttattaattggcctaatttcaatattgttgtgtctcagggaatagggaggcctaaggagagagagagagatggggcatggacagtcagtggagcagtcagaacacacatattatcagaagttcactgtcttatacgggcatggttccgggcccaaaacaatgacaatagtaacatcaaagatcacaggctgggtgcagtggctcacacctgtaatctcaacactttgggaggctgaagcacgtagattgcttgagcccaggagtttgagaccagcctgggaaacatggtgaaacccagtttctacaaaaaatacaaaagttatccaggcatggtggcacacgtgtgcctgtggtcccagctactcgggaggctgaggtgggaggatcgcctgagcctgggagattgaggctgcagtgaaccatgactgcagtactgcactccagcctgggtgacagagtgagaccctgtctcaaaaaaaaaaaaaaaaatcattactcatgaggcaggagaatagggtctggaagcagggaacctaaatcctcaccttttctgcactggcagatgggaaattggctgtcttcaacaaatctgactgattgccggtggagtctttgtttgcaacttggtaacttcactctggccttggaatggttgctgtccacaatcaatcagactgattgtgggcagagtctttgtttgcatagaagtataactctgtaacttcatcctagcctctgattgctttttgcaaccaatcagatgtttgcacaggagtgtgacctttgtaacattacttcagcctctggttggctgctttctgcaaccaatcagaatgattgtgggctatcacttcatttacatgagatgagcatgaagtggccaatgggaaacttcttgggggtatttgaacccaagaagattctgtatctgggccctgagccactgcttgggcccgctcccacactgtggcgtgttctttcattttcaataaacacctgctttcattcttttgttgcttcattctttctttgctttgctgggtgttttgtccaattctttgttcaaaacaccaagaacctggacaacttgcagtcacgaccctctaccggcgacagtcaccgatcaccatgatggatacctaataaggaaaaagtatgacatattatgagaattaccaatgtgacacagagagccagaggtcacatactgttggaaaaatggcaccaagagacttgctagacacaggcttgccacaagccttcaatttgtagaaaacacaatatctataaaatgcaataaagcaaactacaataaaatacaggtgtgcctgtattctattttgccccaacctccacaacaaccatgaggtgcaaagatatttcacccccattttgtagaccagaaaacaagcagagagaggctaactgtaagggtgtgtttttagatcccaatgccaggaagggtcagagtgcaggttctgccacatttgacatcatgcggtccagggggccactgcacctgatgcccgtgtcatcagggctgggatttggtctccaatgcacctgtgtgatcaaggcccaggatgtgtgccggggggtggctttccttcctgggggaatgtgactggcccataccatttctggtttaactttctagtgaatcgattttcatgtctttagagtttaaactgtgcaggcagcctcagggagagccaagagttccgtggacagtcttgaagcttgatgggctcttctgagtgacagcgtgagcgccaggcacgagtccagactgtgatatgggctttgaccctctgacctcattgcctctctgtttatccgctttgcttcctctgcagctgatgtcattgtggttcacatttcgcagtaggatgatccctggggagtgggtagtgagggacacttgttggggagggcctgtctggacctagggacagagctgggatcatcagctgtgacctgttggccagatcccagcaccgctctaccccatggctcaggagcttactatgtttgttacattgctaaatggtcagaaagaaggaagaagaaagaaggagaagaggaggaggattattattcacgattggcctaaggggctcacacctgtaatctcagcactttggaaggctgaggcggtggactgcttgaggccaactcaatccccgtctctacaaaaaattaaaaaattagctgggagtggtggcatgagcctgtactcctagctactcagaaggatcgcttgagcccaggagttggaggctgcagtgagttatgatcgtaaaaaataaaaagatttcatgacatgtgaaaacgatctgaaattctaattcactgtccataaatgagctttactggaacacagtggtgcccattccttttgctttgtgtgggctgttttgctcccacggcaaggttgagtagctgggacagaggccatgtggcctggagagcctaacatatttaccaactggcccttcccacaagacgcttgccaagcccaggccctgcgttccctcccttcctgcgatgacaaagtcaggttggtagtcacatttcatggggttggcacaaaccgttggtgcttaatcggagtggaagaggctgtgctgggggccaactgcacaactgcacgggttccagagagaaggcagcggcccacatgccatcaactgtcccacacctgtggctgccagggcctgcctccgagggacgcccccctccgcccgccgtgtgttcattaagagggccggggtctgtggtggccccacaggcagcgggcctctgtcctgtgctcaggtggtgctctttgaagggtggcagggccgggggctcctcttgtgctgccagagctggtcccagagacccacctgcccagggccagcccgtgggatggcagccccgtgcgtgacagtggccttcgcatagtaccatctgctcccagtggggcggttctagacttgctctgggaagcagcctttccagataacaggagacaccccagccagtcggtggggaagcaggcctggggtcggccacggggactctggagggtctcttcaggccacggctggtgtttcctgaggaagtggggccgacacagaagggccagggccgcgtggttgagaagtaaggatgaggatgatgggggctgctaagatccctggccccatcactgtgcagcttttctactcacttgtggtaacaaacgcccaacatgacatttatcatcataaccatttttaagcacccagttcgataacctaagtatatcctaagtatatccttagtataacctaagtatatccgcgttgttgtgcatccagtctccaaaatccttttcatcctgcaaaactgaaacactgtacccactaaaccacaactctcctttctcccttcttttcagcccctccccagcttaccattctgctttctgtctgtgaatttggctattctagagaactcatgtcagtggactcactccgcatttgtctttctgtgactgacttattttactttgcataatatccgcaaggtccatccacgtggcggtgtgtgtccgagttccctgcctctccaggctgagtgatgctgccttctgcggatgtgtcatcttttctttatccattcatctcctcatgggcactcaggttccctctatctcttcagcatgggtgggcatttgccccaatcctgctttcgcttcttttggatctacacctggaaatggtgtgctggatcagaggctcttcttacttttaacttttgaggagcagccacactgatttccatagcagttgcaccatctcacattcccaccatcggcacacgagggtcccaccgtctgcacatgagggtcccaccgtcttcattcacatcctcaccagcatgtgtgtgtgtgtgtttttttaatagcagtcatcctagtgggtgtgatccgttttgttttaagtaaggcataattttcatacaacaaaatgcacagatcttgtttcccataacaggagttttggctgatgaactttcatgaaatctacatcccacccagggataggacatttccggtgctctgggaagctccctctcacctttccctgtcatccctctccacccggcaccgggttgctgtcacaccggaagagcagtgcctgcccctgcccttggtgccgatgcacccacagtaaagacagaaaggtttgcgtgggcccaagcctgcctccccattaggcagccctgctcagggctgctcctcgcacccggggaggaggtgcctgtgcctccaggagcagggagagggctgggtttgcaggtgccctgcatccagctccagcctctccccagcccgctgtgtttgcttttggagggctgagcacaggatgtgcccgtcctctgcctgatgacagtggagtgatgtcaggccaggtgcttcccggagggaggcagggcgtgcagcctgctgcctggcaggggagggggtgggcaaggttcccaaagagagagctgagctacgggccgactatgcatcagcgatgtttacaacagcttcccgccctcaccagtttcgaagtttgcgtttccattctgagagcctcattttcagccccacttgctgctaaagggcagtttatcttcagaatcaacattcggatagaatcgcgcaccctctaacctgggagcagaatgtgctcggctttgacaactatacagtttttatgagcagcaggttcctgaaaagcttgtgttcccaaggccaggctggtgccacgggaaggcctgtcccaggctgagctccgtctctcctcccgtggatttactcagtaacgttgcaggagtctgagccccgacagtgtcgtgggttcattcaaccttcagcaaatcattattcctgtcagacgcttgggatacagagttgagcaggctgggaaccagggggcagactcaggggatgacagcatcacacataaatactcatatccacctaagtgtgcattcaggctgggtggtcagggggtcccttagaggaagccacaccagaagggtggatgggatttagccaatgagaagagctgaggtggtgagtctcaggggagctcggatgcagcctctgtggggaggtgtgtgaagggccatgccctaaacagcgtccagggcagtggggtggccagcccctgactgagggggttaatgggggtggtgataagccccagaaccagaattgcttttcaggcctcagtggctcagattccagaggctttggtgtctttggcagaaagagactgaagtttctatttcagttctctcagtgaaaaccagcatttctcacccaggctttcatgctttggctgagttctaggctccttttctcccaagacatggagcagattccaggctggtggccgtctctgtgtggtgcctgagctgcgtggcatcgatggctgtgagctttgtccccactggctcacgagctcacagggccacactgccttctccacaccgtaccccacagcatcgcggtgccagtgcctcctggcctccagaggtggctattggctgcctcatgccttcctcagagatctggtttttaaagtaaagtgagggtcagtaaatggagggagacagaagcaaagaaaaatgggttggacacagaaaacaaactggctgtcagagctctgatctgaatctcaggcatcctttcctttcttttaaaaatatgtgattgtggtcaaacatacagaacataaaaggtctacccatttttaagtgcgtagttcagtggtgttaaatccattctcactgtgctgcagccactccctagaactcttcatcttggcctggtgcggtggctcacgcctgtaatcctaacactttgggaagctgaggcgggcggatcacccgaggtcgggagttcgaaaccagcctgaccaacatgatgaaaccctgtctctactaaaaatacaaaaattagctaggcgtggtggcacatgtctgtaatcccaggtactcaggaggctaagacagaagaaccacttgaacccaggaggtgaagtttgcagtgagctgagattgtgtcattgtactctggcctgggcaacagagtgaaactctgtcccaaaaaaagaaaaaaagaaaagaactcttcatcttgcgtgaatattaagcattttttgaaaaacaaaaggaggccaggcattgtggctcatacctatagtcccagcacctgtattatcaaggcccagggtgtgtgcctgggtgtggcttccttcctgggaaggatcacttcagtccagaagttcgggaccagcctgagcaacatgacaaaaccccgtctctacagagaaatgcaaaaattagccaggcatagtggcacatgcttgtagtcccagccactctggaggctgaggcaggagaattgcttaagccagggaggtggaggttgcagtgagctgagattgcaccactgcactccagcctgggcaaaaaagtgagaccctgtctcaaaaaataaataaaaaataaaaaaggaaaggaaagaaaataaacagagcaaggttctcttcaaaatttagctgcagccaggtgtcgtggctcatgcctgtaattccagcactttgagaggccgaggtaggaggatcacttgagcccaggagtttgagaccagcctgggcaacatagtgagaccttgtgtctactaaaaaaagaaaaaatttaaaaaaccaggcatggtggcatgtgcctgcagtcttagctgctcagggagctgagacgggaggatcccttgaggccagttcgaggctgcagtgagctgcgattgttgcactgcactccagcctgggtgacagagcaagaactttctcaaaaaaaaaaaaaaaaaaaaaaaggccgggtgcggtggttcccagcactttgggaggccgaggagggtggatcacttgaggtcaggagttggaggtcccccctggccaacatggtgaaaccccgtctctattaaaaaatacaaaaattagccagttgtggtggcatatgcctgtaatcccagctactcaagggctgaggcaggagaaccgcttgaacctgggaggctgaggttgcagtcagccgagactgctccactgtactccagcctgggcaacagagactctatctcaaaaaaaaaaaaggctcagctgccaggagccagcatttttcctcttcccatcattccctttctgcagccaactcctgcccctcctcatgtgcattgtgggggctgtcacagccctgtggcttctgtggggcgggggcacagcggtgactgctgcccagggtagagcttgtgcagaggctggctccccatgacctgcctgctcctgagtaagtcactgactcccctgcagctcttagcaagccaagggacagggctgcttgctctgcagattggtgaggtgagggacaaccccccagcctagcggctctagtgctgtgggaaggtgcagtctgcggcagaagggcccagggacttggcctgttaagggccacgccaggctgtttccttcatgtctcacctgcagcaccaccacacctgccgctggtggagcccctcccccctcacacccccacttctgctccttagcaggtcttagttctcattttgcatcacagtgggccatgtggttttccacaaaacaagagggagaaaggcaataatacagtggctttcgatttgtttcgatttgtagtagtaaagtctttctttaaataaaatcttccctggtaattgtgtcatggaagaaataagcaaagcatctctagttgaggcagccagggtgcctccccgtgctggggcgcccccactcccaaagcccgtatgcccagaggcccctccactgacccaggaatttgtaaaccctcgccttggtgttcagcaggaagctcacacaggggcagcaacaagccccaccgccaccccaatccccccactacgcctacattgaggctgccctcgaggtgagttcatgcatacagaagtccaaatttagaccacacgttgggggtgatactgcctgaggtatgaagataggatttgtctgataggcagatgtaaaggctggaaattacctgcatgctaaaaagcaaaacagagattccaggttcccatggtggagggaagcacagaatctagtaagacaaacctcccagaaactcaccgcagcaaccaagttgaagagaggaacaaccacaggcctcgaacttcaggagcccatggtcagggagaaacagaagattcgggtgcagcagggcatggctcccaacagaggcgtgaggatgatgtgaggctggggtcttaggggctccagctcccctgctaatttggagagatgggggctagaggcagccctaggaaaggatgggaaggagctgcagccccccagcactacgagtctcggtcctgggtggctggcgagccctggggcactgtgctgagggcaccgtgggcctacactcgtggccaagcggcggcccctgggtggcctacactcgtggccaagcggcggcccctgggtgctcctctctgctgccatcaccgccttctgcctggctttgtgtcctctcccatcccctgctgggctccatcctgcacaggcccttcccatgacccactccccttcaacccatgtctgctgctgaccccccagcctagcctggggtcccatccttcctgctggcccttctgcctcccgttgcctcctcagcccaccctggtttcccaggcctgcgaccggcttcggactcagcgaggctcacattcaggagtaaagctgaggacctgcactcagagctgggcattttaaaaatcatctttatgaagttgatcagaccaaaaaaaaaaaaaaaaaagacaaagaacttgcttgcatcacaaacatcctagtgtccaccatccctcttcagaaatgagatctgacaatgcactccacatcccagaggcccccgaggtgagagtggcagtcctgaatttggtgttaacattctttgcgtgggtttgtacttctaatgcctaggcttattcctccaagtgatacagatcacactctgcagtagcacaggagatatagagacctattacctttatgcatggatagatgtagctatctctccatctgtctccctgcccatgtatgtgtgcatttctctatccattcatatatgtatgtatgtatctattccggtacatatacacctgtctatccatctagccatgtatatatgtatgtgcctagccatccatccatgtacatatgtacctatctatccacctatccattcatgtatgtacctattcatccccctgtctattcatatgtgtgtgtacctatctatctacctatccatccatgtatgtatgtacctatctatccacctatccatttatgtatgtatgtacctatctatccacctatctattcatatgtgtatgtacctatccatccacctgtctattcgtgtgtgtatgtacctatccatccacctgtctattcgtgtatgtacctatccatccacctgtctattcgtgtgtgtatgtacctatccatccacctgtctattcgtgtatgtacctatccatccacctgtctattcgtgtaagattgtacctatccatccacctgtctattcgtgtatgtatgtacctatccatccacctgtctattcgtgtatgtatgtacctatccatccacctgtctattcgtgtatgtatgtatctatccatccacctgtctattcgtgtatgtatgtacctatctatccatccacctgtctattcgtgtatgcacgtacctatccatctgtcgttctctttcttctgcagctcctttcctcacctgcagtgtgtgagcctgccacgctaactgtgacatgtgtcactccagttcattcatgaatagttgcagggttgctggggcacacagagtaccaggggaatgccagtcctggctgggccacagtgtccatcctactgatggagtgtcagcggggtgggggtgggactccagttttctgcaagtctagcacggctactgaacagtctcatgcaggcgcaaggggttccagggcaggtactgagacacgggcttgccaggtcccacggcatggctgtccttggcctcctgacaccgccacagctctggccaaggctgctctgcatcaccccccaccacaggcgtgggagccgtctttctggtttctgtggtccgttctgtttccagtttgtgaattaccagttcctgttttcccccttttcaatgggttcttggccttttcttaattaagttattagattctatgaatattctggattctaatgcttagttggctctatcctctgcaaagcttttctcccagtctgtggcttaaagtcttttcactcctttattttgtcttttaatatatagaacgtttacagtggaatgtagactaatccagcaatctgctctgtgctttcagtgttttaatcaagaagttatatttcataccaaagtcataaagccttctgcattttcttctgaaagttgtaaggttttatcttgaggtctttggagtaaggtgtgacatagagattcagttctgttttctttttccacatggacatgaatcgagtcccttctccctcctacaggctgtaatgccacgtggccatctgttacgtggccacagtttcttgagtctggtcctagactcttctccgtcctgggactgctcatctgtcctgagccggcacagcctttgggtatttcagctttgcgatccatctttatgccccacgttgcccttcagaacacatctgactgttctcggctcttggctttcccatcacatgttttagaatcagcctgtaatcccaacactttgagaggccaagactggaggatcacttgaagacgagttcaagaccaccctgggcaacaaactgagacacggtctacaaaaaaagtttttttaattgttaaatgtggggccgggcgcagtggctcacgcctgtaatcccagcagtttgggaggccgaggtgggtagatcacctgaggtcaggagttcaagaccagcctggccaacacggtgaaaccccgtctctactaaacatacaaaaatgagtcgggcatgatggcgggcgcctgtagtcccagctacttgggagtctgaggcaggagaatcgcttgaacccgggaggcagaggttgcagtgagccaagattgcgccactgcactccagcctgggtgacagagtgagactccatctcaaaataaataaataaataaaataaatagttaaatgtgctgctgtggtaaagcacacttaaaaaaactgcattttacagtcatttgtgttagtgagcctgaatgctactgaattctgaatattgctcttggctcccacacccttcagagctttctctctgacactcactgggtcatggtctgccacgtgactccacctgcctctctctttccggctcccacagccttcagctttctgacattttacatggtccaggggcatccttgccatgttgaaaatagaggtgatggcaggcatgatacagcagaaatgttaatacaagaagagagaacttattagctatgcatgactctgtgctccaacacttgaacatttcattaaaatagacaatttcctaggaaaaattaaatgttcaaaacctggatctaaaaaaaaagtaacctttctattgcctctttgggtgttttttataattattttcagcatattggccccttcttaaggggaaatcatgtagagtagaaaaaaaaaaagcgcaccgggtcactgtgatgcctccccagttaccacccgagtggctccagcagacactctggagaccagagcccggccaccagagcaccacaggggaccgccacctgtcagggctttaaaaatactgcgttcctttctctgtttccttctactctactttcactctttttgaaagtgaggttggcctttttacccaaaaactctcaaagtcctcccacacactgtcgttggccactgtcatttagcaggagggagtgtgtccagcctgggaagtgagcgactgcaactctgtgtttgcctaaacacagtttcttgttgccgatgcctgctctcttctcttatttactctgtgtaccgagggaggtgggcaggcggtgtgagtaacctctctgctcccgtcgaagctgcagccccgtccttgtgtgtgttcacagacaacattggcagtaccatcatgatgactggtgccacgtcctgaacaatcggcccacggctgtcgggatgcacctgggcttgggaactggtgtcttggatgtgggacacttcccagatcacaacgagagcttccatggagagggagtccttcccagactgtcagatggccacctcagagacagtagtctttgggatgaatacttttgtcaattttgtctgcattcctgaaggaataggacatcattttgaagaacttgggagtattattttacctaaagctaggaaaacaggaaggaactgtgttgttattttagatactgttcagatacgatatgagcattgaaatgaatagggtcatcagtcgctgtggtttgattttattgtggtaaaaacacatattatacaatttaccatcttgattttttttttgagacagagtctcactctgtcactcaggctggagtgcagtggcacgatcccagctcactgcaacctctgcctcctgggttcaagtgattctcctgcctcagccttccaagcagatgagattacagacatgcgccactatgcccagctaatttcattttttcttattttttgtagagacagtgtctcactatgttgcccagcgtggtctcgaactcctgacctcaagggatccttccacctcagcctcccaaagtgctggcaaagtgctgggattacagacatgagccaccactcccaggctttcacttatttttagattggattatttgattttgttgttgttgagttttaaaagtttttgttgttgttgtgtgttgttgttttttttttcttgagacagagttttgctctgtcacccatgaaggaaataatgtatacagtggtctatttccaagacaaagtgcattgaattggcttaggtcagcaaactacagaagaaacaggatataccaggcccctgcttggatagccaatgactgcttgtcggccttccccttccctctcttcttgccacgccccgcacccccaccctccccacccttagttgccttcacctgaaccaaagaaattcagtctaagacgaaagcttactagtcttcaaaatagctcgctttgtctgttcttttcagcctgcccagctacttaggtcacaagtcaaaaacttggagaacccctgagctaactaggattgcaatgcattgtgggctgcaacaaaatgcagcaagataactgtaaaaaaaaaaaaaaaaaaacacctacaggccctacctaacaatcagaacaatcagtaggcgatgtccgggaaggttgtagccccatagtactcactttatgaggaactgggggagggacctgcacactaggggatacattgcctattgaaactgtgctggctgtgcctgcctatcaggcaagatcgtcattaaaagtctcactttggctgttctctgggtctctgagtccattctttgggtttggatgagtgagtttgtttctcacatccaggctggagtactgtggcgcgatctcaactcactgcaatctctgcctcccgggttcaagcgtttctccagcttcaggctccctggtagctgggattacaggcgcgcaccaccacgctcagctaatttttgtatttttggtagaaatgggttttcaccatgttggccaggctgttctcgaactcctgacctcaggtgatccaccctcttcggccttccaaagtgctgggattacaggcgtgagccaccgtgcccagccaagagttctttctatgttgtggctgttgatcctcgtcagatgtatgatttgccaatattttttctcattctgtcagttgccattactctgttgactgagtcctctgatgagcagaagtgttaaggtttgatgtagtccctgcggtctggcttttgttaaaaacgtgttggcagggggagggagggggtcagaaccctgcaggaggttctattacttctggtgatgcattgctgagctggggcgttctgtgatcaaatttcactggcttttcttgatttctttccagcctgaaactcaggtgtggagtttatgaaagttcttcatgcaaaagtgagtgttgtccctgagattgctaaagccgatgccctcacctgaaggaaagggagcatagcgtaggaacgctggttcctggatgtctttctttggggcctatgtcatggggggcagagtcaggttctaatgttgattctaaaagagaagaccccatttgagagagtaagcattgctggtttgctaaaagtaagaaaagtttctactcgttagagagactgtctcctgcggttgcctggccgccctttgcacagcccgcgaagggcacgtgggaatcctgctccattccaggtcccgggccagtagctccaggccgcgccagggtcggtgcagagcggcatttcccgcccccacacaccttgacaggccaggtaacaagagaggcctttctagaaagtccctggaaaaggctctttcctcccaaaccggcagattatgctttgtatgtctgttgtggcaagaaccttttcttgttttctttctcaaagtgacaaattgatggcagggcagataaatcgtattttctttccttctttctttctttctttctttctttctctctctctttctttttttttcttggtgacagggcagataaatcatattttctttctttctctttcttttttatttttctttttgagatggagtctcgctctgtcacccaggctggagtgcagtggcacgatcctggctcactgcatcctccgcctcctgggttcaagcgattctcctgcctcagcctcctgagtagctgggattacaggcatgcaccaccacgcccagctaatttttgtatttttagtagagatggggtttcaccatgttgggcaggatggtcttgaactcctgacctcaggtgatccacccacctcagcctcccaaagtgctgggattacaggcatgagccaccatgcccagcctttttttcttttcttttcttaatagacagggtctcactttcagtcactcaggctggggtgcagagtttcaatcctagctcactgcagctttgacctcctaggctcagctgatcctcctgcctcagcctcccaaagtgctgggatgacaggtgtgagccattgttcccagctaaatagtgctttttcttctctctaacattgaaatatagaaagtatgaaaaagccactcatggtcaagcggcatgtccctgcagagctgtcagccacactgcctcccagaatccaggttgggggtttccgatgctgtctgttccatgtgacctcacagcctcctgaaccaactgatggccccaaatgtttatccccattccagatggcacctggtggtacctgaaagtgacctctgggctgcgaggtgcgtggtaatgtccctgtggcccatctctagatcgtgaagagggtgatgtgaatcatagcacactccaggacatcacagggccccagcacaattgtgtatgctgtgactccgtcacccaactacttcgagtcttcaaagacattgaattgccattgttctaatacttatttgcctttggttcccactccttcctccccgtggtgggaagaaagttggggaatgtgcacccagaagatgtcggggctggatcaagccccttttcagtcactgtcattcatagttgagatgtgaactctgcaaaggcagtgagtacagaacattcttgtttccagtgcaaatccactgtgaccaggaagctgtgcctaggtctctgactccagccacccatacctcctctccctgtacccagagccctggatgaaagcatgagtctgggatgctgggaagagggcagacaatgacagctcccaggcgctgtggaccaggcaggctctgtgttgggctttcctggcagacgatgctgtagttagttaatcctctcgaggacatgtgagatgagggtatcattaccttagagatggaggatctgagcctccagcagataagcagctgccccgctgcagagaactgaaaatgaagctaagcttgttggcttttccccaccagctgcctcccacttcctccacctgctctgtctctgcagaaaacatcaagaatgcaaatccagccccttggccagctcatttgcacacacactcacctcaggggtctctgggggtgtcttggatgcagacctccatccctcacaccctcacacctgtccgtccaagggtcaggccatgctggagtgcctgggctggcctgatggagatgctgcaccagctgagtcatggcgggaaaacagccgggaatcacccaatatctattccttccttcctttccattttcttttacaacagcaaaatgatgccaagatttttctgtgcttcccctgttataggctgatttatggcctccctcccaagttcctatgttgaactcctaaccacccagtcccaaccccatatggctgtatttggatagatctttttctttctttcttttttgagacggagtcttgctctgttgaccaggctggagtgcagtggtgcaatcttagctcactgcaacctctgccacctgggttcaagagattcttgtgcctcagcctcctaagtagctgggactacaggtgcgcaccaccacgcctggctaattttttgtatttttagtagagacgggatttcaccaggctggtcttgaactcctgacctcaagtgatctacctgcctcggcctcccaaagtgttgggattacaggcctgagccactgcacctggctgagagagggtctttaaacaggtaattcattcaaaatgaggtcatgagggtgggccctactcttgtatgactggtgtcctataagaaaaggagactagggcctagcaaggtggctcccaacagtttgggaggccaaagcaggaggattgctcaagcccagatgttcgagaccagcctgagcaacatggtgagacccccatctctacaaaaaattttaaaaattagccaggcatggtgaggtgcacccgtagtcccagctacttgggagcctgggaggctgaggcaagaggatcgcttgagcactaggaatgtggggcttcggtgagccatgattgtgccactgcactccaatctgggcaacacagcaagatcctgtctctaaaactaaataaagaaagaaaaaggagaggagattaggacacaggtatgcccagagggatgaccctctgagggcatggcgagaagacggccatcgacaagcccgggagaaggtccccggaagacataaccctgcccacgccttgatcccagacttccggcccgcagaatataagacaataaaggtctgcggtgaggccaccagccagtggcactttgtgatggcagccccgggaggccaaaacagctgcctgttccccacgtccctctcccagcagaagcgcatgggctgctcttgagccccagctgcagtccatcactgtcagtgctaatgcgaagctcccctaagactgacttgacaatattggcgagtgggcttgacccaccagcctgcatccggtgccggtgaatgggcacttacgttccttattgaaacgctacttgtggccctctgcttcccggagctcctggcaacagcccaactttatgttccaaataggaaaaggctgcttgatttaaagactcggacttcattaggcgttaccttgatttatggaaaaataatactgaatggttgcataacaatggcccactgctcacctacgtgtggcctggggttaataaaaccggcacatttgtctctcccacgatgacgtcaacgtgtaccagcccttctcttccacatgggaaacgtgttatgttgttccaattgtacattcacttggtgaagggttgtgttaagtgattccaaaaattgactgtgtatattttctctagggaagttattgtatattattttagctgggaacatctctcgcacacaattactaatcagaagtgaaaatcaggatttgtccccggcccacctggcggatctgatgcagcgccagggcagcccgtgaagacgggcgctcttcctccgtgactctgggccaggcagaaggagccttggagaggctgcaggaggaagcccggcttgaggccattcctgttttgtcttgctggaattcaaagatatttgttaatcctttccccccacttgagttgagaaggcctggaatgaggtttcacaagctgtgccctgtagagctcctggggaaactggctcgaaagaatgacttctcgagagggaaactaatatttgcttattttccccccactaacttcccaagggaaggctaatctttagaaacacagaaactttggaggccaataaaattgagagcaagagaagcgagattgtttcattgttgccaccatgaaggagagtttgtttttactggatttctttttcccttcaggaaggctctggtaagagtcctgatagattattctcgcacccctggttctggctttccccccattgtttcaattgcccttttaatcaccacgatctcagtcaaggtcaaggctgctgtttcatgtacccgtgccccgcctgccctcctctgccgcggattcccatggggatgtgtgtggctgcatgaccacccttccgtgtcaccaatcacaccgagcagccctgaagccagcgtggggtgtcggcagggtggtggcactcggcatttcccagcctcttcttggatgcctggggtcctctctgcagggtttggtgaggccctgctggggtgagagcccttggcagccccaactgtgtctgatcacaggcgaagcatttatgaggcagctgggtcccataacagaaacagggaaaccagaggcagaagtgacattacgaagtggcttacggcgctgctaagtcagggttggggtagcaaagcgtcatatagggaactgaaatgcttttcagcgcacaatagcagtgaactggatgggaatcttcgggccgagagaagtccaggcagaggcgttaaaaagtttaggcaaggaaaaggagtgaagggctggacctggtggggtggggtcccattcccaggagagtcggccctgccccagcagcttccagctggagccttcaaggacctggagggggcaggaccaacccctccaccctccctgcccttcaccctcaagttcacctgcagggctgtcttcttgcttactaaggcctgggagagtttaattccaaagcagaggatgatgactggagaaacggatgcctggttgagtcacttctgggggctcagcattggaatccctctgtaacctcccagaagcagaagtggtggcgtccaaggctgcccaggcccctccagtgatgaggagcccagaccctacaacacgcctttgccccctgcacacccttcctgctgacagccccatcccatgctcctccccatctgacccgtgtgtgtgtgtgtgtgtgtgtgtgtgtgtgtgtgtgtgtgtgtgcgccccccacccccgcagacctcccgagacagctctggcagccccacctgccaggggtcaagtgcaattcctctggaagtagcatctttcacatggaaacgttcctttattttcagtagttatggtcgtcagcgagccctcttaaaggagtcaggtgtcctgcttttgttaaaatgacgttgtctcctaactcttagagaagaggaaaaatgtctctgcccagctggcatgctggggcacagaccactgaagccaaggctttggactcgggggttctggaggctggaggaagggagaaggggatgcagcgcagcgtgttgtgtgtgcatagtgctccagggactccagaggagaaaggagtccctggggaagagacatgggtctgcctcttatcctaagtgctttctggtgctccagggagaagtgtttcttgtctgagatgtggcagacatttagaatcattgctcagaactgtctcatcttaaaccttttaaccagaaagtacagaaccattgctccaggggaaatacaagcttgtgagagcttctgtttgcaacatttcattcactaatccatacataaccttgttgtgtgtctgtttctgttgaaagacactttaatatatattattgcttctttaatgtattcaccaccagcaacaccataactcttgcctgaacgcagctcatctaacacacatattttccgcatacagttcattgcagccttttttttttttgagatggagtctcgctttgttgccaagctggagtgtagtggcgggttcaagcggttctcctgcctcagcctcccgagcagctgggatgacaggtgcctgccaccacgcccggctaatttttgtatttttaggagagacagggtttcaccatgtcggccaggatggtctcaaactcttaacctcatgatccacccgcctcagcctcccaaagtgctgggattacaggcgtaagccaccacactcggccttttttttttttttttaagagatggggatcttgttctgtcactcaggttggagggcagtggcatgatcacaggtcactgcagccttgacctcctgggctcaagtgattgcccacctcagcctcccaagtagctgggaccacaggcacacgccaccacatccggctcatcacagcctgtttgtgcttaggaacactagacagccctcaaggtctttacctataaagtagagatgtcagagatgtcagaggcacttgaaccagagcaactccatcttgaataggggctaggtaaaataaggctgagacttactgggctgcattctcagacagtctttttttttttttttttttttttttttgagacggagtctcactcggtttcccaggctggggtgtaatggcgtgatcttggctcactgcaactaccaccacccaggttcaagcaattctcctaccttagcctcctgagtagctgggactacaggtgtgcatgaccacgcctggctaagttttgtatttttagtagagacggggtttcgccatgttggccaggctggtctcgaactcctggcctcaggtaatccacccaccgtggcctccgaaagtactgggattacaggtgtgagccaccactcctggcccctccggttaggcattctaagtcacaggatgagataggaggttgctgcaagatacaggtcataaagaccttgcagattaaaacaggttgcagtaaagaagcaggctaaaaagccatcaaaaccaagatggtgatgagaatgacctctggtcattctcactgctacactctcaaactgtcaacaatttgacaatttacaaatgccatggcaatgtcaggaagttactctgtatggtctaaaaaagggaggcatgaataacccaccccttgtttagcatataatcaagaagaaaccataaaaataagcaaccgaggccgggcatggtggctcacgtctgtaatcccaccactttgggaggccgaggcgggcggatcacaaggtcaggagatcaagaccatcctggccaacatggtgaaacccaactctactaaaatgcagaaaaaattagttgggtatggtggtgcgcacctgtagtcccagctactccggaggctgaggtaggggaattgcttgaacccgggaggtggaggttgcagtgagctgagatcgtgccactgcactccagcctggcaacagagcgagactccgtctcaaattaaaaaaaaacaaaaaacaaaaaaaaaagcaaccagcatccctcagggctgctctgaccatggagcagccattctttattccttcactttcttaataaacttgctttcactttactctatggactcgcccctaattctttcttcctcgagatccaagaaccctctcttgggatctgaattgggaccactttccgggaacagagacagcagggcaatggccagaggccacatgagacagtcagtagtgtatggaggcggcagcaggtgcccagaggcatccccggcccacccccagagcctggcctgacatccaggcctcgcaggcttcaggccaggaccctaccagcaaccccccacccccgagcaccccaggtgtgtatgggtgggtggggcctcccgtcagcccacccaggggcctgtcacacccctgctgcacacagcctctgcactctggactgcatgctggagcccgtgggcatcagagccacgggctgggcttggcaggatgcacctcccagcaacggtgtgctcacttctcctgtcctcccctggctctgatgacactgtgaggcagcaaaccagggtcctgaagggacctctaaagatacagtgtgtgcagggaccctgcccagggtgagagcagctggagctcttgccgtgatcatctcaggctgcccaggtgaaggtgtttccccaacagccctggccacagaggaggccaggcctcttccctgcccaccagtctcatggccctccagccttccctcccgccacctgggccagggccaagagtcttggagggaggttcttattgctaccaggtgacccctgctcctggctggcatggagcaaagtcacccttgctatcaatttaacacagatgaaagatcatgcttgttcccattcccaccacctggacatcctcctctcctggaccctacagcctgcgtggggggtgcatttgcaggaatggaccttgcctccctggagtacctcttggcttacagccccatcctccctggggtctgctatcctactgacctgagcgtgcacactgctgatctcctgacccactgtttaggaaaatcactcctttccaagcctcctgtttccttgcaaatgctctagagcaggggtccccaacccctggggtcacaggaatgggccacacagtaggaggtaaggcgcaggcaagcaaatgaagcttcatctgtaacagctgctcactgcttgaattaccccctgaactctgcctcccatcagatcagcagcggcattatattcccataggagcacaaaccctattgtgaactgtgcatgtgggggatccaggctgtgtgctcacgagaatcgaatgcctgctgatctgtcactgtctcccatcgcccccagatgggaccatctagttgcaggaaaacaagcccagggctcccactgatgctacattatggtgaattgtatagttatttcattatatattacaatgtaataacgatgtcataatgagaatataataataacagaagtaaagtgcacaataaaaatgtaatgcacttgaatcatcacaaaaccaccactccaccctcggtctgtggaaaaattgtgttccacaaaaccagtccctggtgccaaaaggctggggaccgctgctctaaggcatagcagtctttaaccttttggggcaccatggagacttgcatagcctgatgagctctgtggaccccttagaactgctgatgtgtgtcgcttacattcagagatggagaaaatgctaaaccttagtgaaaataaagatgctttttctcccatccaagctcctgagtgccctgaatgccacccatggggaccttggggaagccctaggacagggatgtaggtacagattgacagtccagagctgccatcagggagaagcatttgcaaagcacaggctctgcaaatggggtctacttcctccatcccccaagcctgtcttctgcttcactttgccaagactctgccttgccccagtgttggagcaggatgccagatggcaagatgggcttatgggctgggtcttctgtttggtcgcggcagagcccatggcagctgtaggaactttgacggggaaggggcaggggcgggagcaaacctgtagcgtgaaagtatgtgaacgctctgtcatggagggcaccccaggccgtgtccaggccagcttcaccctgtctctgggagaaggaagcctggtcagagctgaggaggctccagggcaccaggccttgtccctcttgcgcctgggcgtgatgctccccaatggcgtgcgccagtcctgggaccattgctgccggccgtgtgtcttcttccagggtgcagaatcccttgtcaagctgggtggtttgatgccagcccctgggcctcgaagctcccttcctgatggagtgctgccatttggaaggggtaactttcgtggtcatttttttaaatcatggtaaaatatacataactacataacataaaatttaccattcttccttttcttttcttttcttttcagacggagtctcgctctttcgcccaggcgggactgcagtggcgttctctcggctcactgcaagctccgcctcccgtgttcacgccattctcctgcgtcagcctcccgagcaggggactataggcgcccgccaccgcgcctggctaattttttgtatttttagtagagacggggtttcattgtgttagccaaaatggtcttgatctcctgacctattgatccgcccgcctcggcctcccaaagtgctgggattacaggcgtgagccaccgcacccggccaaaatttaccattctttctaaccattttaaagtgtacagttctgtggtattaagtacattaacactgttgtacaaccagcaccactgcccatttccagaaggtcttcatcttcctaaactgtaattctgtgcccattaaactccccatgtcttcttctcccagcccctggcaaccacgattctactttctgtctctgggaatttgacgactcttataattggagtcatgcaacttttgtgtctggttggttttactcagcagaatgtcgtttcatccatattgtggcctgtgtcagaagttccttcctgtcaaaggcggaatgatactccatggcaggtttacaccacattttgtttttccactcatccgtggagagacactgggtgggtccctccttttggctgttgagaatgatgctgctgtgaatgaagtggttagaagggggctttcagacgtgtgaaaggtgtctttgggaattttaatttcagctcccacaaatgagtaaaatttgtctttctgtgcctggcttatttcacttaacataatgatctccaattccatccatgctgttgcaaatgataggatctcactcttttttcatggcttcgtagtactccacggtgtatttgtaccacattggcttcacccattcgtctgttgatgttcgacaccttattattatcgactgtagtcaccctgctgtgtaatagatctcttttcttttttattgatatttcagaattgtgcatattttggggcacatatgatattttgatacatgtatataatctataatgttctaatcagggtcgttgggttattcatctcctcaaacatttgttttttctttgtgttgggaacattccaattctagttattttgaaatatacagtccgggcgtggtggctcatgcctgtaatcccagcactttgggagactgagacaggtggatcacctgagatcaggagttcgagaccagcttagccaacatggtgaaaccccgtctctactaaaaaatacaaaaaattagctgggcgcagtggcaggcacctgtaatcccagctactcaggaggctaaggcaggagaatctcttgaacctgggagacggaggttgcagtgagctgagattgtgccactgcactccagcctgggcaacagagtgagactccgtctcaaaacaaaacaaaacaaccccagaaatacacaattcattatcgttaactataactttcctactctactttcaaatactagaacttattccttctacctatattttttaatccctggtgatctcttttcttatgggagcagtgtgcgccctgatggtgtaaggtggaaacccgccccttgttggaaccaggattgaatatcaccgcacaggagctgaaggttcccacccggcaacgtccccccttggctgtgaagcagagagcccagggctgctcgtttccagtagtcctcctggcagagcaccgctgaggagggtggtgaggggaggagaagatgcattctgcagggagaagcatcatagtgggggccggggactctcctgcgtctcctaattgcccgactgtcatgtgaccgatcagtgcactccgagcattacacagagcagtcatccaaagagaggcagcgcctcacagcccttggctggagaggagaatggaggctggaggctccagaaatttgggatgggaggagaaaaggaaacagaggtgccccttcccctgtcttattgcagggaatcagtaaaacgactactggagttcactggcttctctgaatctttgtagaatttctcctgcacctctgatcccatccagctgcagacacagtgcctgttcagcagggtgtgtgtgcagaccacggactcacagacggggaccctggggaccccaggttctctcccctcactgaggacaagagaggggcccccaccccatgttaatgatgcggggcctgcagggaccttaagttgcattagcatggcatggaacaagagagaaaattcagaacctccagcttgtgatatgcaacaaccaaaaatgtggctgagtgtggccgccttgcaaaggcctgggccctctttaatgggtgcttgctgccctctagtggagagatgaggacggggggtgggcgagcttgctcaaggacactcactggggaagggcggtttgcagacaggtgtcgtgttttggtatatatgtgtgtatgtgtgttatgtgttaggtgctgcgagcatatgaaatgaattacaacgttgttatgggctgtactgtgttcccccaaattcacttgttgaagtcctaagccctgctcccttagaatgtggctgtatttggagacagggtctgtaaagacctgaatgaattaaaatgaggtcattagtgtgggccctgatcccgtatgacgggtcttcttcttcttcttctttttttctataacatctaaagtgagatttatttgtgttaagctttcagaacatttcagaacatttgctgcgactcaggtaaaaataggtaagtattcacagaatatgttaagtctagagttcagaaagttatttcaactaaaataggtcaatcctcacatctgaaatcacttagacattactgatgtatttggaagtgtttctgtatagatattttaggctgacggtgctcagtgctttagggggtcaggtaaacccagttctcgtttgttcagcggtgcctcatttccactacataaagcttgttctccagttccaccaccaatgcctactttacgtgatgttgcactgtgttggtgccatgtaaggtgattatattatgaaaggcctctagaccaccttgttcaaatgtaacagctggtttcagtaattccaggagcaagggaactgtctccaacaattctcaggttgataaatttgattttccaagtattctccacaaaagggcagcaggtgagcccaaaactttgttcaaaaatgcccaagcaagtgttccctcgatgtcccagcagttcccagcagttccaaccatcaccagcccatgaagagaagaagtacatttctacattgggctgagaaaaagaaattcttcttttactagtgacggcaaacggagactcatgatttctgtcccatggtagtccatcccttttttttttttttttttgacggagtctcgctctgttgcccaggctggagtgcagtggcatgatctcggctcactgcaagctccacctcccgggttcacgccattctcctgccttagccttcccagtaggggactataggtgcccaccaccacgcccggctaattgtttgtatttttagtagagacggtgtttcattgcgttagccaagatggtgttgatctcctgacctcgtgatccgcccgcctcggcctcccaaagtgctgggattacaggcgtgagtcaccgcgcctgacctcttttttttttttttttgagacagagtcttgcttggttgtccaggctggagtgcagtggcgtgatctcggggcactgcagcctctgcctcccaggttcaagtgattccctgactcagccttccgagtagttgggaccacaggcatgtgccaccacacctggctaatttttgtatttttagcagagatggggtttcaccatgttggccaggctggtctcaaactcctgacctcaagtgatccacccacctcagcctcccaaagtgctggtgtgagccaccacacccagccagtctatcacgttttgttctgacttgttgtaatagaatctaagctgagtctatcacgttttgttctgacttgttgtaatagaatctaagctggacatcatgctgtggttcccattcatcttgaggtggtcccaggaaagaattgtgagaattaagaagtccaaagacccggtgacagaattctcccaggcaatgaaaatcaaccttttcagctttttaatcttttgcctgctgtcgaaagagctggatgtcctctgtctttgtaactggctctggtgtttccttcaattttggctgtgattgcttttatacgctaaataagactgtgttttttagtaactggaggtataacaaccaccccctggtgttgccaagtacttaaatgtgaccagaaaggtggacgtttttacgcctcagaagttctgcccttggactgtccactaacattacatgaaaggtgctccaaatcctcaaatcagcaagtgctgcccatgacatggataatcccggaagctgcgccattgtcactgccaccacctcctggcgggcccagctgcctaagcctgtgtagtggttccgaaacgggaaaggttcctttgtccgccttgcagggtgtgggatgggggtgtggctcgtttcttctgtgtcctgcttctcccaccgctagagggggcatacagatgggcaggttgtggggctcaggccccacagcagggtctagagatgaatgtttacagctgaagccccagttggcgtatgctactgtttgttcttttagttttgctgtctataggcggcttgtgttaaccagctcaattagaccctctacttgtcgcgtggacagagggctttctgtatcccgggttcttgccttggtgtaccggaagagtcggatcacacatgagcttggataatgggtgcaaggttttattgagtggaagtagctctcagcagatgggggaaccagaagacagatggttttcccctggagtggggcagctgggtggcccagacactcttccgactcccggccaaactccacgtcattccgcgatcagtggcatgcctgtgcctgtgggcgcattcctctcgccagccggccacttgtggattcctccgccagtgtgctcctctccacgtccagccgctcctgtctctgccttgctagggtctgggtttttataggcgcccgatggggcgtggcagcaagagcggtcttggaaaatgtaaggcaggaaatgcctgtcctcacttaggtccgtgggggtggagccttagtaagaaacggtctttgctttgggaggccaaagtgggaggatcacttgagcccaggagtttgagactagcctggacaacacaataagatcctgtttctaccaaaaaaattaaccaggtgtggtgttgtgtacctgtagtcacagctactgagaaggctgaggtagcagggtcagaaaacgccctcctatacccgcacttcccttggcacttcccttacccccttccgtatcatttaaagggaccatgcttctcccttctcagcatttccgtatcagtttcagagcagtggatctgccatggtggcagggattccccaggattctgcctaagcggggtctgagactaactgggttctaggccccgaaccccctccactcccaggctccagtgacctggggtcagcatgaggcttgggaaggagtggctgtgttccatggcacaggtctgcccttacattggtggtctttgggctgcaccaggcaattggtgacggtgctgcacagggccatgaatctcctcattgtccagtagcccaagtaggttacgacagccctccgtctctggagagctgagtcctgacatctcgacccccgggacagagggagaggacgatggcaataatgttgcccctgtggcccaccaggcccgcaccttggcaacacacaccagaagtcatggcaagtgttcttataagaagaagagattaggcctataatcccagtgctttgggaggccaaaatgggaggatcgcttgagcccaggagtttgagactagcctgaacagcagagtgagatcccatttctaccaaaaaaaagttagccaggtgtggtcttgtatatctgtagtcacagctactcagaaggctgaggtagcagggtcacttgagcccaggaattcaagaccagcctgggcaatatagcaagaccctgtctctacaaaaaattcaaaaattagcctgggactatgcctgtagtcccagctacttgggaggcagaggtgggaggatcatttgagccctgcagtgagctacgatcatgcgactgtgctgcagcctggatgacagagcaaaaccctgtctcaaagaaggagaagaagagattaggacccagacaggcacagaggaaaaggaaagaccccgtgagaacgcagggagagaacggccattgacaagccagggagagaggcctgagaaggaccaacccttccagcctccaggactgcaaggagtaggtgtctgttgtttaaggcgcccagcctgtggtacttcatcatggcagccccagcagactaacacacacggattctgtccttcaggagccagtatttgtagataaatcatgactgaatggcagtggtgagcaaaacttaatggcccttgccagcttccaaacgcccagcgctttctgcgtgcaccctcaggcagtggcatcgggcacacaaccattcctagctcaggaaaccaaggggaagaggttccgctgcaggcccgggagcccagccgatcccaaagactaaagacctaagccccgggcttcccagaggaggggcacagccttttgaaagcaagaggaacttctgacaaggtgagcagggtgaggaagttattgattttgattttgatttcccctgaattctctataaaaatagagggggcaaccagaacccaggtagtgaaaccaaagcccatgttggaatttacaacctagtgaggggaggccgcggcctcggggcgaatccatgaggggttggcatgtgtggtggggggagtgctgggggagactgggggacatggcagcgggatggggaggggaagataacaccaagcagaggagaacgaggacgcaaggagaaggagacggcggactgcagaacgagcagaggagcgcaacagatgctggcaggccgcagagaaggggcaccctcctttaagtttaaggacgcaaatttcaaggtcaaatcctatgcaaaggattataagtgtattacaagaaaaaagaaaataggacgaataatgtaaaatggatgaaaactatgccctaatcatcatgtccaaacaaactttaaacaagaaactgatacaagatacgtgacaacatacatacatttctctgaacttaaaacttttaaaaaattgaaaatgaatggcaagaaattaggaaagggttgtaatgaatatttaaatatcatttcagagatgaatattaaacaagaaagacaggagcaaatagacaagggcctaagagaaatagaagttgaaaagaaagaaaatctttgagcataaagaaaagagaaacacgtaaaatctcactacagaccagcgctaacagaagaacatttcaacttgatgacagggaacactagttttgaatcttgattaagcaaaaagtttctcctgtgcacacaagaggaattccaaggataacaagtgttgatgaggtagtgggaaattagaacccttgtgcactgttcatgggaatgcaaaatggtacagtatggggattcctcaaaaaattaaaaatagggccaggcaaggtggctcacacctgtaatcctaccactttgggaggctgaggcgggaggatcacttgaggccaggagttcaagaccagcctgggtaatatagtgagaccctgtctctacaaaagaaaaaaaaaaaattagccagacaaggtgatatgcacctgtggtcctggctactcaggaggctgaggcaacaggatcacttgagccaaggggttcaattttgcagtgagccatgattgtaccactgcactccagcctgggtgacagcaagaccctgtttcaaaaaaataaataaactagaatgaccacgtgatccagcagttttatttgtcagtatgccggaaaggtttgaaaagcaaggtctccaggaggtacctgcacacccatgttcacagcagcatcattcacaacagccaacctaacctgggttgcttggggaggagcaacctaagtgtcagtcaacagaagaacagatgaacgaagtgtggtttatacatacactggaaaatttagcctcaaaaaggaaaggaattctgatacatgccctaatattgatgaaccttgaggtcattatgctcagtgaaataagccaatcacacaaaagacaaataccgtatgattccatttatatgaggtgccatgtgtggtcaaacccatagagacagaaagcagaacggtggttgccaggggctggggaggtggggatggagcattggcatctaatgggacagtctcggttttacacaatgacaaagctctggaggtgggtgtggtgagagccgaatgtgaatgcacttattgcccctgaactgcatgcttagaaatggtcagagtggtgaatgttatgcgtattctaccacaatttaaataacttaattaaaaacaattccattcttctcattagtagacctatcttatgaaaaactgtactcttattatatttgaatttcatcaataaaaattgtgtggaaatgtgtttgtctcttgtgatgtaagtacctacatggtatctccagttttggctcttctcctgcaaggtctgaaacatattctctctggccccgcacagaaaacagttccggacccttcctctagaacagggttcggcatgcggcagatgcccaggaaagagtgaaggaccaagcttcctcccttcttcaccggatccctctggcagcttcgggtccagtgaaagagaacccaggccagtcccttctccgtgagcctcgccccacaaacaccggcctcccttgcctcatctctcgcatcttaaatctctttcacctacgaaccgactcaagcatcagccttagaaggatgccctgggccccgttcctctgtccatgcacatccaggctctaccccgggagttcaaggccaccttcagttcctatatcctgtccctgctctctgtgacctctgaccccacagccccaggtctctaagcgtcctcccacctgagccgctgctcaggccagccccgagcagccctctgtgggtcctgattcccaaagagcatgatcccaggtctttctgggtccctcccaccttgccctacttcatgcttccgtgcctagccacacccctgcacaacctgtgatctggcctcaggaaatctgtttctcatgtctgctgtataggcttggctgcccatggcagcaggaagaacctcgcctcccttgctcacacagcaaaggcgtttaggcctcatattggggaagcccagggtgggaggcccctgactctttggacccatgacgacatcaagagtatcttcgtatctgtgctctgccatcctcagctggctttcctcagctgccatttcagtcttcacaccagatgtgatggtgtcccaggaagaagaggccatctcttcccatggctctcttcgtcaatagagagtacattctagaagccccgtggtaggcttccctatggcttgcacaggactgaatcacagaactgtgtcctcagcagtcactggcaggggacaggggtcacccgaactgggtggaggcccgaacctgacacccctgagctgtgctaagcagagggctcctgaacagaattgagattgaggccacagggccaggctgactccctcctgccccacgtgctctccggtgagaccctgcttggtctgcaaagccgagctcgatgccctccctacctcttctctcctaggcctcatccacggccttgtcttgggccagacagccatgtgccatgtctgtcctcccatgcagcatctgcaccgtgggggtggggggggagattctctgccacgttcagcacctcaaaggcagggggtgcatttcactcagctctgcatcctgtgcaccctcagccatgccggcagagcatgtgtggggaagggcccgagggaccccagggaaggaagagcactgtgtctgcatccagaagaaagttctgaaaaaaatgggaacctctgtgactacaatgaacttgtaacaaaagcaatgactttgctcttccaggaggcacaaaaggagccccaggcagtgcgcaggacccccaggcagtggtcaggagccctgggcagtgaggaggagccccaggcagtggtcaggagcccagggcagtgaggaggagccccaggcagtggtcagggggcctgggaagcagccaagagccctgggcagtggacaggaagcccaggcagtggccaggggccccaggcagtgagtaggagccatgggcagtggccaggagctgcagcgtgccagtgttcgctctggcactcagtcagggacatctggaccagcatcctgcatgggctgggtctcaggctccttgctccatgaattagcagaatctcaggcacctgctcttgaatatgggaaggtgacatagcacttctagtaggtcttttcctaacctcttccctttgcagttattctttttcaacctaagcatgccaggtgatgaccttgtgattctcctaacatacaaatggcaggcatggaatagttcctacccagggtgctgtgctggccaaggcttttccagcttggagcagacctcatgctcagccaggagactgcccacggccttggtgagttccagagtctcctctccctgcaggggtgtcttcaggagcccacaacccagcaagtccctcttcagtgaaatgtgcgggaggaggcactgcaaggccccaggcctccaggaagccggaaggtgctgatggggtgcaaggcagggcagggctgggggagggggggcgcaaggttcacagaggcagtgagtggagttctgttaacagggaaatgaattaaaatatgtggtgcgtggactttgggtctcgaggcccagaaagctgaggcaaggtggcctgagtcaaatggacagggattgtctgcccaggagctggttcagccgacatcagagatcatctgtctgcacaatggcctgctagtaaagattttcaagttgttcacacgtgttacccttgagggtttagaaacattccctgggcactcccagggtgctcagacagatgctgtggactggtggccagtgagcactaatcatgacttttatttttctttttgagacaagggtctcactttgtcacacaggctggagtgcagtggcacgatcacagctcactgcagcctcaaactcccgggctcaagtaattctcctgacttagcctccagagtagctgggactacaggtgcataccaccacgcccaactaattttctatttttagtagagatgaggtctcactttgttgcccaggctggtctcgaactcctgacctcaagtaatcctcccatctcggccttgaaaagtgcttgaattataggcatgagccactgcacctggcataatcatgctgtttatatgttatgatgttttgatatcttgggaggccaggctggctgggaagagactgtccctcccagagacagctaaatcctacagatgataaacaacttgcctgggagcctgtttattcacatgcagaccaacccatcccaagtccatactcccaaccaccccctctatctaactcttacaaccaagccattatttcctgggccctgaatcccacagggccaggcagcaggcactagggatggccctataccctggccagccagccttattcagaccagctggtcctgagctgttcacctgccccaccttgaaaggctctggtctcagctttccctgtctcctctctgcttcctgacccaacctgggtcacccactgtggccttgtgggtggggtgagtgtgcccctcctctccagaaatacgaataatgaagtctttcagtggcgctggccactctctgtgggtgctgacacctctgtaagttaaactcccataggcacgatggagacgccttgtgactcagctcctcagtgccaacacgggctgccccgtcggccacagcgcggccaaagagcccagagagcgttagtatctgtagccaggcccctgttgccaccccagctctcccgtaacctcacatgcatggcgctgctctacttcacctcagaaaaaggacacacatttacgttccattttttacttcaaataattgtttagattgtggtaaaatacatataacacaacattggccatttgaaccaattgggtggcactaagcacatccacagattgtgccaccatctccaccatccgtctccaggacttttcaaccgtctccaccatctggctccaggactcttcagcttcccaccacaaactatccccatgaagcactcattccccatccccattctcctccccttgcccctggcgcctaccattctatttctgtctccgtggatttgactcctctagggtacctcatgtaagtggaaccatgcagtatttgtatttgtctttctgtgactggtttatttcactgagcataatgacctcagagttcatccctgttgtaacatgtgtcacaattccttctttcttttttttttttttttttttttttttggcaaggtctcactctgtcactcaagctggagtgcaatggtaggatcatggctcactgcagcttcaaactcctgggctcaagagctcctcctgcctcagtcttcccagtagctgggactataggcatgcaccaccatgcgtggctagcattttatttttgttgagagagggtctcgctaggttgcaattctcccatcttagcctccaaagtgctgggataacaggtgtgagccactgcacccgacccagaatttcctccttttgacggctgagtgatgttccattgtccgcacacacacattttgtttatcctttcatccattgatggacacttgtgttgcctccacctactcgtagcaccctggctgttatgagtagtgagtgcactatctcttgtgtgcagttgtctcatggagaccttgctttcctgcctgtggcgttagtgcaggtggcaggcaggtcggtgggcaagcaggtgtgccctgtggatgacgagaagctttttctgcttaaagccctgcatggatcaaaagttggaaaatatatttgatttttacaatttgttcaaaattaatcaagcaaacactgattttcatgtattttctgagatctctgctataaaacagaaaaccaccaccctctttccagggaagcatcttcttcctggctccctccttcccttcgggccatggcggcatcctcggatcctccctagcccattcatatcacacggcttttcctcctctgcatctcgataccactggctcctttgggaggttcctctgagccacccatgcgcggggtgggttgtcatgaaaagtcaccagttccacctccagccagaagtcccacaaaagcgaagggcactgaagacaaaaccacccttcccttctctaaaggaggaggggcggtgcttcagagggtgtcccccaaacccgttctttagagcagggtccccaacccctgggctgcggagtggtacaggtctgtggcctgttaggaacgggcctcagagcaggaggtgtgcggtgggcgagtttaccgccgagctccgccccctgtcggatcagctgggcattccatgctcatgggaggcaaactctatcgtgaactgcgcatgtgagggatccaggtggtgcgctccttccgggaatctaatgtctgatgatcagaggtggaacaatttcaccccgaaactatcccccacccaaccccatcggtggaaaaattgtcttccacgaaaccggtccctggtgccaagaaggttggggactgctactttagagcatgtcctcggagtggaggtacctgctctccacgcagtacagcatctggctgtgtggtggctgcagtccagtgggtctgagaggggtggagggggaaggtggagaaggagaggagggaggaggggagggagggaaaggtgagaggggaagacgaagggaaggagaagaggtgggggagggggcaggggggcagcattggccaggtaagggcgtgtccactgtgaggcaccgtgggattcctgggcgaggactgtgagacactggtgagcgtgtgtgcagggctctttcgggcttcctctgtttttaatgacatcagagtgcgtgccatgcatggggctgtcctggtgttggcactgaccgcttggagcccagctgctgccccctttctcaggccacagatgcgcccaagagcagggtttgtccaggcccgcctgggcccgctccacgccatcctgcagtgcccacgcagcagcggtgccaggtcttccttcagcacccatgcgtggttacctgtggccgatgtggcaggcgtgtagggtgtgactgcagaactgcatggaccaagcaccgtctgcctcctaagggagcaatgggaccgaggaagtgggccccatgttggccttgaccagctgtgcccacctccttttgggaacagatgtgccaagaacaaccaggctaaggaaacgtggctcgcacaccgggagccctggggaaagactacaacgatccttttaataatactttttactgactgtagtcatagtgtaataatttcagaaaattcagaaaccatagaaaagtatacagaagaaaattaaaattacctggtgcccccaccaagccacagtgatcattgttcaagcattaacaaattttcctggattttggtaaacagatataagtgcatattttaagtggaaatattctatatttagttttgatccttgttttcatccctttaaaaggatttttcatattattcaatcatctcctaaaatacagttaccagtaactgccttcattccattagatgctgaaatggatttaactgttctctggtggttagtcatatattcttgtttctttcttctttcctggtatacataatattgggaacatcttggaacaagatggctgtactcaattattgaaattcctaaacgataaatgactggaggagaatcctggatcaaggaggggctcctggaagtgctctgggccctgctggaggcacaggccttggccacaggccaccacacataccctttggaaagagactttgccattgtgatcggccaaaaatgaaacctcactttattttattgtgagacagtgtctcattatgtcacccaggctggactgcaggctcactgcagcctcgacctcctgggctcaagagatcctcccacctcagcctccctagtagctgggaccacaggtgggcgccaccatgccaggctaattttgtattttttgtagagatggcatttagccatgttggccaggctggtctcaaactcctaggctcaagggattcgctcatcttggcctcccaaagtgctgggattacaggtgtgagccaccacgcccagcctttttcacttaattttgaagcttggagataagttttatataggcccatatacggctgcctgaaacctcactttaaaactaggtatatttgtttgctgcctgctgaggctgagtgctcattgcctgttgcttggctatttgtaattgtcttttgtgaattgctttttcttatcatttgcccatttttgtactggaatgtttacctcttcctggctgatgtgcaaaagctcttcaattcccttgtcatatgccttccagcatgttatcatggcctttgcacgtctatgggtttccatggccagacctctggcttcttatcttcacggcatcacctttgctcctatgcttagacgatgcttgcacatttgagggaaagggagcattttcctgtttttcccctgtatttggtttattacatttggctcttaaatccggtggttcccagttaggggtatgcatcagatttcccaggagggcttttctaaccataagtgcctgcctcagtccatccagatcttcccatcagcccccagggtggggcgggtgatggcgggtgggggtacagccttgttttggaaaaagtgccatagatggtgcagatgcaagcctctgattatgggcttcttccttctgccacatgtgtgatgtaagataaggatgctatttttattggcttatattttaagaatagctgattgcacaagtatatttattgtgcaaacgtgccttctttccccactcagtgacattatatctaaaccaaattctcaattataacacgggaacgtttccctttagcctgcgaagatccagtgtctcggttatggtgtttctggttccccggccacttggaagacacctggagctctgtgatcttggtggggacctcaatgtcagccgggacctcaatgtcagcagaccctgtgtccccagtgtggctgggctttgctagacctgtggagcaatagctagtcaggcttgtggccccaatccagccagcatcacacactgtccagcctccctctgacatcagcataggtctaatgtcagcataggccctctgccgcagggctgtgcccaaggacactctcctgctctgggtcctaagggagggaggatctcaggagaggcctctcctcatccctggcagatctctcaaaatggcctgcagccgggattccagacacctgagctggtgtgagcccactccccaccgctggctctcaggctggagtggggccaggatgtcactgagctcctcagagtttgcagaccatttgcccctcagctggacccctggcccaccagggacttgagcaaagctgttccatcaacgcaggggaggtgagaccacatctaatcaggggtctgatgtacacacagcaccatcaccatctcagaaaggttcatcacccaagcacaaagaagctggacttggacatctgacagcaaagcatgacccattttatgtgaggcaacgagtctgaaagcaggtaaccgggacacccaaaagctgaaagcacagaggggttggcgaggagtgcctggacctctccctccccaggggtgtcttcctgtcagagttatgcatgctcttgccagagagggcaagcttgacagccaactgccgcttgatcagcctgcccctcctgcctcacctcctgtgcctcagcacgtggccatgtccccatgcccccccaaatctcgcaccctctccaccgcacagagctctgtcttaggtccccaagggccacatgggcagcctgagtccttcccttacttcgcaggtttttccacagcactggtgttgattgctccctcccttagggagctctctcctgactctaagctctcctctcgagctcctgcctctcgctccctggctgggcacctccctttcctctctgagatgatgccctccagggctctttctctgcagctttcctcactcaaagtgttttcattctttcccagggccttgcctctctttttatatgggggccccagaacttgtttggagccacagacctgttgtccccgctgctctaggggcctctgcaattgggcacacatagatctttcccagtttactcccaccccagtgagcggtcccacagcctcctgctgccttcacaggcatctgggggcacacacattcatgtggtctgacggcatctcaccttgcacttcttcctgctcgcctgttggaggtgccacagaggcccctccatgccacgacctgtggctgagtaggtttccacacttacttttttttttttttacagttttattcaggtattatttacttaactccaaatacacccattgtattgagtttcagtaaatttatagagtcgtgccactatcccctcagtccagttttagaacatttctatcacccaaaaaacattttcttgtgcctgtttgcaatccccactctctgccccacccctggctcaaagcagaccccgatctgctttctacctgtagatctgccccttcaggatcttgaacatttacttttcgccagttcactgcaagaggttgagtctcagcaagagtaaggaatggctccggagaggtgacaccagctaaatggtggactaaggacctttggaaattctctcctccagaaacttgacgacaatgctggcaaaaaatcatcataatcagctgtttcaaaactctggaaattaaccaaaggcccacagaaatttagggaatgcttattcaagaaaaacagctgactttcaataagaacaatggacttcgtggtgttttgtgggtttttttttgagacaggttattgctctgtcccccaggctggagtacagcggtgccataatagctcgccgtaacctggaactcctgggatcaagggatcctcccaccttaacctcccaaaatgctgggactgcaggtgtgaaccaccacgacttgctaatttttaaatttattatagagatggggtctcactatgttgcccagactggtctagatctcctgacctccagcaatcctcctgcttcagcctcccaaaatgttgggattacaggtatgagccacggtgcctgttctgtgtgatgttttagcctgcactgttctcatcattctcccctcagctccacaatggtcttggagactaacagcccaccactatggtgaaaatgaacatatggcagctgctgaaaggtgtagagagggttggagccccatttccacagaattgtcattatttgaccgctctggtggttccataaagaccccacccacaagactttctttatttgatcggacttgggggatgcccagtataaagagctgtttccctaggagcatttgttgaaaacaaccagaggtgattgttgtatatcatggttgcctgaggtggtgtataacagttggagcaaataacaagctaacccagatatttaaaaggaaaagctgggaaacaagatgtctataggggctttgacaagctctgacacattcttgggcatctagaaggccatgtgcagggatgagtgtatactcaggagaacctcacctctcacctctggctaaccttgaagctctgcagaagtgggaagtaaaaagtaaggtggagttgccaactgcttggctgagggtcaaaagtgtgcccctacccatacacagagcccctcggcaaaggctaagagacatactggttccaggtatctaaaaatatttgtgtccagtcatttagctgcccattaagctaactgaatagagacttcagtagccacacacaaaaacaaatacaaattttacataattagcccaggaaagtcactgaacaaacaaacagcaacaaaccctggggaggagggggtgcaggaatctgatttccagagttgccatgttatattattttaaaatatcagtttttaacaacaaaaattatgagacactgtccatgagaaagcccagattgttggattcaccgtacaaacaccttaaatgaactgcttttaaatatgttcaagaactaaaaggaactatgtctaaagaactaacaaaaaatatgagaatgatgtcttaccaaatagagaatattaataaagagaataatttttttttttttgagatggagtctcactctgttgcccaggctggagtgcagtggtgtgatcttggctcacttctgcttcccgggttttcaagcgattctcctgcctcagcctcctgagtagctgggattacaggcatgtgccaccatgtccagctaatttttgtatttttagtagaggtggggtttcaccatgttggccagactggtctcaaactcctggcctcaagtgatctgcccacctcagtctcccaaagtgctggggttataggtgtgagccaccatgcccagccataaattatttaaaaaacaaaaagacattctggagtgaaatgtatgataactaaaataaaaaattcaccagagaggctcaacagcagatttatggccaggcgtggtggctcatgcctgtaatccaaacactttgggaggccaaggtggatggatcacctgaggtcaggagtttgagaccagcttggctaacatggtgaaaccctgtttctactaaaaatacaaaaaaattagccaggcatggtggtgcatgcctgtaatcccagctacatgggaggctgaagcaggagaatcacttgaacccgagagttcaagagggcagtgagccgtgatcacgccattgcactccagcttgggcaacaaaagcaaaactctgtctcaaacaaacaatcaaaacagcagatttatgtgggtagaaaaaagaatcattacacttaaagaggtcagttggggttatctaaggaatagaaagaaaataattgagtctgaaaaacagaaagaacaggatgaagaaaaatgaacagagttccagagacctgtggtacaacaaccaagcataccaataaatgcataataggagtgccagaaggaaaggagaggagaaagggataaaacaatatctgaagaaataatggctgaaatttttgataaaaaacatatatgtatagttcaagaagctcaagaaactccaagtggagtaaactgaaagacatctacacctagatgcatcataatcaaactgtcaaaaaccaaagacaaagcgagcatctcagagcagcaggacagaagccacttgtcacacacaatagagcctcaataagattgacagctgatttctcaccagaaactatggaggccagaaggaagtgacatattcaaagtgctaaaggaaaacaacaaaacaaaacaaagcaaagcaaaacaaaacaaaacactgttaaccatcaatctatatcagccaaaactatcctgcaaaaatgaaggagaaattaggacattcccagataaacaaaaacagagtttctcattagcagagcagccctacaacaaatggtatcggccgggtgtctttcaccctgaaataaaaggacattaggtaatatttcaactccaaataaagaaataaagaactccaagaaggataaccacataggtaaatatcaaaaacagtataaatgtatttttatttgtaactatttttttctatctaatttaaatgacaactgcataagcaatcattataagtttaggttgatgggcacacactgtagaaagatgtaatttgtgctactgtggcatgagtggaggacacagctatacacgcacacacacattcatatatatataagaaatttctatttctcagtcatttgaagataattaaatggtacacatttaacacaaaagaagaagtggagaaatgaacaaaacagacataaggcatgtacaaaacacataacaaaatggcagataatcctattcaagagtaattacattaagtgtaaatgtttaaagagcccaattaaaaggcagaaattggcagaatgaatataaaaacaagatccagttatatgttctcccaagaaatataccttagatttaaagacacaagtatgttgaaagtaaaagaatggaaaatgatataccatgcaaacagtacccaaaaaggagctggagtggctatactaatattagacaaaataggttttagcacaaaaaatgttactagaaacaaagtgggaagttttgtaataataaagggtatattcatcaagaagatataacaatgataaacatatatgcacttagcaacaaagtcccaggatacatgaagcaaaaaatgacagattaaagagagaaataaagaattcaacaataatagtcatagagttcaagaggtcattctcagaagttcaacaagaaaatagaagagttggccaggtgtggtggctcacacctgtaatcccagcactttgggaggctgaggcgggtggatcacgaggtcaggagattgagaccatcctggctaacacggtgaagccccatctctactaaaaatacgaaagaaaatcagccaggcgtggtggcaggcgcctgtagtcccagctactcaggaggctgaggcaggagaatggcgtgaacccaggaggcggagcttgcagtgagctgagactgtgccactgcacttcagcctgggcaacagagtgagactccatctcaaaaaaaaaccaacaaaaaacaaacaacaacaacaacaacaaaagaaaatagaagagttgaacaatattataagccaactataactaacagacatctgtagaacactccacccactagcagaatatacattcttttcaattgcacatgaaacatcttcaggatagaccatatattaggccataaaatgagtctcaataaatttaaaaggactgaaatcatacaaattgtcttctcaaatcacaatggaataaaattagaaatcaatagcggaaggaaatttgggaaattcacaaatatgtggaaattcaacaacacagtaaccaatgggtaaaacaagaaatcgtaagggaaattaggaaatactttgagattaaagaagaataagacacagcctaccaaaacttatgggatgcactaaaatagtgcttagagagaaatttaaagctataagcacctatattagtaaacaaggaaaattcaatttaataatataaactttcaccttcagaaactagaaaaggaagagcaaaccaaaaataatgcaagtggaaggaagtaaaaaatacagattacagtggaaataaattttaaaagagaaaagaaaataataatcaataaaaccaaaagttgacttttcaaaaaagatcaacaaagttgacagccttttgctatactgactaagaaaaaaagtcagactcaaattactaaaattaggaatgaaaaagaaaacatcaccaccaacattacagaaaaatgattataagggaatactatgaacaaatgtatgctgtggcaggtggcataatgttcccctaagatgtctatgtcctaatccctggaacctatgaagatgttaccttaaatggcagatgggattttgaagatatgattaagttaaggatcttgatatgggagtcttaacttggattatctggatgagctcaagataaccacaaggattcttacagacgaaagagggaagcaagagggttagagtcaaagatttgaagatgctatgctgctggctttcaagatagagaaaagggtcacaagccaaggaatataggtgacttttagaagccagaaaaggcaaagggacagagtctatcctggagcctccaaaaggaatgcagccttgctaacaccttgaatttagctccttgaaatccattttggatatctgacctcaagaactacatgatattaaatttgtttggttctaagccactaagtgtgtggaaatttatcagtgcaatagaaaactaatacacatgccaacaagttagataaactaaataaaacagacaaatttctagaaagttagaaacttctgaaactgactcaagaagaaatagaagatctgaatagaactacaagtaaagagattgaattagtaaaaaacaaaacaaaacaaacaaaacttcccataagcaaagcctagggtgagatggtgtcactagtgaattctaccaaatgcttaaacagtatttaacaccaatactttacagactcttccaaacagtaaaaaagaagagaacatttcccaactcattccatgaatacccacaaaacaatgccagacaaaagcacacacaaaagaaagctataagccaatatcttttaagaatttaaatacaaaaatcttcaacaaaatactagcaaacaaaacccagcaacatatacaaaggattctgtactatgagtcagtagcatttatgtcaggagtgcaaagttggtccaacaatcaatcaatcaagtcaatcacattaataaaaagatgggcaaaaaaacacatgagcatattaataaatgcagaaagcatctaacaaaaatccatcaatctttcatgataaacactcaacaaactaggactgtaagggaatttctcaacctgataaaaggcatccataaaaacccccacagctaacatcataatggtggaagactgaaagctttccccctatgatcaagaacaagacaaagatgttcactcttactacctctattcggcattgtaatagaggttctaaacagggcaattagataagaaaaaccacccagattataaagaagcaaaactatttctatttgaaaatgatgtgattttgtataaagaaaatgctaagaaatccaaaacaaaagaaaacaattactaataaactagttcagcaaggttgcaggatacaagatcaatatacagaaatccattgtatttctatacagtagcaataagcaatgtaaaaataaaagtaagaagataattcgattataatagcatgaaaaaaataaaatacttgggataaatttaacccaaaaagtgagagacttgtacaaaacattgttgaaagaaattaaggaagacccaagtaaatgggaagacatcctgtgtttgtggattagaagatgtacagttggccaggcatggtggctcctgactgcaatcccagcattctgggaggccaaggtgggcggatcacttcaggtgatcctgaagtggtcaggtcaggagttcaagacctgcctgaccaacgtggcaaaaccccatctcgactaaaaatacaaaaattagccaggcatgttggtgggcgcctgtagtcccagctgcatggcagactaaggcagaaaatcgcttgaaatcaagaggcagaggttgcagtgagctgaaattgtaccactgcactccagcctaggcaacagagtgagaccgtgtctcaaaaaaaagaagaagaagaacatgtacagtagacctttgaatgatggtggcaattcggggcacaggtgaaaatccgcatataatttttgactccccagaaacttaactatgactagcctactgtttcctgaaagccttaccaataacataaaccatcaattaacacatattttgtatgttatgtgtattgtatactgtatgttacagtaaagtaagctagagaaaagaaaatgttattaagaaaatcacaaggaagataacatatgcttcctattcattaagtgaaagtggatcatcataaagatcttcatccttgctgccttcacatccaaggaggagaaggaagggtggggttagccttgctgcctcaggggtggcagaggcagaagaaaatgtgttcatatgtggacctgtgtcattcaaacctgggttgttcaaggatcaactgtaataatgcaatactccccaaattgatctacaaactcagtgccacctgacttctttgcagaaatgggcaagctgatcttaaattcatatggaaatgtaaggggtccagaataacaaaaacaatcttgaaaaacaaaataagagcaatgttgaggactcacacttgctgatcccaaaacttgctacaaagctatagtgagggagacgatgtgacactggcataaaaatagacatataggccgggcgtggtggctcacacctgtaaccctagcacttagggaggccaagatgggtggatcacctgaggtcaggagtttgagaccagcctggccaatatggtgaaacctggtctctactaaaaataaaaaaattagccagacttggtggtgtgcgcctatagtctcagctacttgggaggctgaatcacttgaacccgtgaggcagaggttgcagtgagcaaaactctgtccaaaaaaaaaaaaaagaaagaaagaaaccccatctctactaaaaatacaaaaattagccaggtgtagtggctcatgcctgtaatcccagctactcaggaggctgaggctggagaattgcttgaacccggaaggcgaagattgctgtgagccgagatcgcgccactgcactccagcctgggcaacagagtgagactctctcaaaaaaaaaaaaaaaaaaaaagacatatagatgaatggaatggaatttagagtctagaaatagaccctcatatttatggctaactgagttttgataaggatgccaaaaagacttaatgggggaaagagtattcttttcaacaattgtgctgagacaactggatatatccacatgcaaaagaatgaagttaggctccacctcataccatatacaaaaattagctcagaattgatcaaagactaagtataagaactaaaactataaaagtcttaaaagaaaatagaggtatgaatcttcacgaccttggatttggcaatggtttctaagatacgacatcaaaagcataagcaaccaaaaaaatagataaatgataaattattaaataaattatttaaaaataaaagtattcattaaatcaataaatgtaaatacttttatgcttcaaaggactctataaagaagtgaaaaagacaacacaaagaatgggagaaaatctttgcaaatcatacatatgtaagtccctgatggaacttgtaactagaatataaaaataacttttgcaactcaataataaaaagacaacacaatttaaaaatgtacaaaggagctgagtgtggtggctcaggtctgtaatcccagcactttgcgaggctgaggtgggaggatcacttgagcccaggagttcaggaccagcctgggtggcattgtgaaatcctatctctactaaaaatatatacacacacacacacaaaatagctgggtgtgatggcacacacctgtagtcccagctactcaggaggctgaggtgagagaatcacccgagcctgggaagtaggggctgcagttagccgtgatgacatccacactccagcctgggtgatgggagtgagatcctgttttaaaaaaaaaatgcacaaaggacttgaataggcatttctccaaagatatgcaaatggccaataagcacatgaaaagatgctcaatgtcatcagccatccgggaaatgcaaatcaaagccacaatgagataccccctaggatgatggctataatcaaaaagatattacaataataagtactggcaaggatatgaaaaaactggaaccctcatgcactgctgatgagaatataaaatgatgcagctgctgtggaaaacagtttggcagttcctcgaaaagttcaacattgagttatcacaagacccagcaattccactcctgggcatatacttaaaagaattaaaaatgcgtgtgggacacagtggttaacacctgtgatctcagtgctttgagaggcaggaggttgacttgagcccacgagttggaggctgcagtgagctacgatcgtgccactgcactccaacacaggtggcagagcaatatcctgtttccacatatatgtttataaacatatatacataatagtcaaaagatggccatcaactgatgagtggattaaaaaaacgtaaaagatccatacagtggaatattatttagtcataaaaaggaaaggcccaggcgctacctaaaatataccaagccccaggtttacatagggccccaggtcacactaggctctaggtagacactggactctaagtagactttaggccccaggttcacagccacacctcaggaggataccacaccccaggtagctgtaagactcaatccagacaccagtcccccggtggagaatctacgccccagctggacatcaggttccaggtaaacaccaaggcccagttgggtttactggatccattggtggacatcaggcaccaggttggcacagagcccccacatagatatctacaccacaggtggacatgaggccccaggtacatacccagtccgcaggtgactatcgggccctaggtgaacactaggtcttagatgaacttcgggacccaagtggatacccaggcccctggggaacatcaggctccaggtggacaccaggacccatgtgggcaaccaggtccagaggtacatcaggttccacataaacacccaacctccaagtggatactgagcccccaggtgtacacaccagtccctcgacaactgaaaggtcacatactctcaggccaaatgcaatagagtcatctctcccaaaaatatgtatttgggaaagcgaaaactacacttctcaatcattctcaagtcaagggactcttaatagaaggccaaatacacactgaaagaaccaaccatgaaattcccacatccaacaggagtgcaatgctgctcaactagtcccagagcaagacccaccacaggctttgcatggaggacacacagattagaagggaagaatggaaatgtgggacctgagattgcaatacaagaaaagagaaaaaggcaaccgtgcataccaagaaacccaagaaagaaagggtgacgtggagaaataactaacccaggcccagttttccaagaaacattagaacccgcactgcgaatgaagtggcaggccgaatcgagccctgtctagattttcaggtgtgggtctctcctagatgacttaaaagcctacaaattgctgaggtcaccctgactatgtccgacccaccttgcagaaattcaccactgggaaaagacacccaaaccaatgcagttccggagcttaccttggagaagcttcctgcagtccctgggtgccactggctggctctgcggctttcttggagggcccgcggcctcagcccggctccctccctcagctctggtgcgtggccgcagatgacccgagcggcctgggcttgggcttctggtgccctcgaggagccgccctgtgtgctcacacaggctcctggcggcgggcagcacagcactctcacttttggtcaccggtcctttcccgagggcagtctggcggggcacggctccagggccccgagtccagcacctccctgaaatcttcacgccacaggcaaagcagtagggcaacttacccaggctctgcctgagccaagatggcgccttcctcacagcctgtgcaggagggcgaggtcccagatgatgaggcgcgggacaagggcaactcgccacccattcttcccagaaagagggcaggtgcatgggggcacaccccctacaggtggacataaggccccagtggacaccgaggccacgggaaaacatcaggccacaaatagacactggacatcagacaccaggttgacaccaggacctgggtggacaccaggtctcaaggggcctccagtccctgcacagacatcaggccccaaatggacaaatcaggtcacagtttggcacataggcaggccccaggtggacaccaggccacaggtacataacaggccccaggccaaaaccaggtcccagaaggacatcagacatcttagtgtatgtcaggtcccaggttgacatataggccccagtggaacaccaggccccacttgccagtttccaagtggatatccagaccccaggtaaatatcagcgtcaaggtgaacaggaggccccaggtggacaacaggcctcagctagatgcctaggcccctggtgaactccagccccctgatgaacattaggccccaggtggacaccctggccccacgggaacatctagttccaggtggacatcagacccaaggtaaatacccatccccaggtaaacgccagaccccaggcagattacaggtcccagaaaaacacccaggtcccatgaagaaatcagaccctaggtgaactctggtctgcagggggacatgaggctgggtatccacctgggacctggtgttcatggggtgggggccgatgtccaccttgggcctgttgttcatctgtggcctggtattcacctgggccctgagagtcaacctggtgcctgatagccacctggggcctacatagccacctgggggcctggtggtcacttgaagcctggtgtcctcctggggcctgttaccaacatgcggtgtaggtatccaccaggggcctgatgtccacctgaggtctggggttcacctggagccttggtgtcaccctggggactaatgtccacctggagcgtggtatccatctaaagcctgtggtctgcctggggcattattatgtcccttgaagactaagtatccaactagggcctgattttcacatgaggcctgggtatctgcccgaagccttggtatcctccttgggcctgaagtccatctgtgacattctgtccagctagggcctgggtgtgaacctggtgcctgatgtacgcctcaagtccagcgtgcacccacctgggacgtgatggccacctgaggccatatatccacatggagccagggtgtccacttggggcctaatgttcaccaggaacataagtatccacctggggcctcatgtcttcctggggcctgggtgtcaatgtggggcgtgggcatccacctgggggctgatgtccacttggagcctggtgtctacctggaaccaatttttcaactgggaacctgatgtccacctggtgcctgatgtccatttggaaactggagtccacctgggaactggcatacacctaagacatagtgttgagccggtgtttgatgtccaatgttcaccaggctccaggtggacaccgggcctcaggttgacacccagactccaggtggacaccaggccccagatgaatgccaggtccccggtgaacatccaggccccaagtggaaaccaaaacctcagatgtctaggcattagaccccatgtggacatccaggccccaggaagtcatcaggccccagtggacactcaggccccaggtggacatggagtcccaggttgacacccaggcctccagtgaacagcaggccaaggagaattccaggcccagcaggccccaggtggacagcaggatccaggtggacacaaggcccccagatggatacataagaccctggtgaacatcaggctccacatggacacccaggccctagaagaacaccaggcctcgcgaggatacgaaaattcaaataaacactaggccccaggctgaaatcagttccaaggaggacactagacctcaagtgacaacctggccccaggtggctatgtgggccccagctggacggcaggtaccagaattgacatccagggcccaggtaaacaccaggccccagaaggataacaggcacaaggtagacataggccccaggtgcacaccagatcccacgtggatatctaggacccaggtgaacaacaggcccaaggtgagaatccggtctccaggagggcaccaaggcccaggcagacaccaggtcctaagaggacaccaggatacaaatggacaccaggcctcgggtggacaccaggctccaagtggacatcagcccccaggtgggtatctggccccaggtgaacacccagtctcaaggtagacaccaggccttaggtagacagtagccactgggtgaacactgtgccccaggtggacaccaggtctcaagtagacacccagtccccaggtgggcaccagagaccaggcagcctgatgagtccccaggtgggcaccagagaccgggcagcctgatgaggctccaggtggacaccagagaccaggaagcctgatgaggctccaggtggacaccaggctgcaggtggtaccaggctcccagctgatacccaggccccaggggaacacccaggccccaggtagacagcaggaagccagtgcaccctaggcacccaggtagatactaggcccctggtgaacatcgggcctcagctggacacccaggccccagggaaacacccaggccccatatgtcaggttgttaggtcccatatggacaatcaggccccaagaagtcatcaggccctggtagacactgagaccccaggtgactatccagtcccaggctgacacacaggcctcaggtggacaccgggccctaggagaactccaggccccagctgaagatcaatgccccgggtggacacccaggccctagctaacgaccagtccccaggattccatcaggccccaggtggatactaaactctcggtggacatcagcaaatgcccaggtcccaggtcaaaaccaggcccctgatggaccccctgaccccaggtaaacatgaggtttcaggtggacacgtgactctaactggatatcaggccccgggtggacacccaaccccatacggatacctaaacccccgatgaacatcaagtctcgggtgcacctctaggtcccaagtaaacacctaggcctcagaagtccagacatcgggccccatgtggaaatccgggtcccaggaactcctcaggcaccaggaaacactcaggcctcggttggatatctggccccaagttgacacccaggcctcaggtggacaccaggcgctaagaaaacgtcaggccccagctgagatcaacccctgggtggtcagtactggcgcatgctaaaacatgtatgagccttaaaaacatcatgctaagtgaaagaagccaggcacaaaaagccacatagtttgtcattccatttacatgaatgtctagaataggcagatccacaagagacagaaagtgggttagtggttgccagaagctggagacaggggagaacggcgagtgactgctaatgggtacggaacattattgggaggtgatgaaaatattctggaattacatagtttatgatgtggcataacatttaaaatatgctaacaacgactgaattgtacgctttaaaaaggtgagtctttttctttttttgagatggattctcactctgtcgcccaggctagagggcagtggcccgatctcggctcactgcaacctctgcctcctgggttcaagcaattcgctgcctcagcctctcgagcagctgggattataggcgcccgcagccacacctggctaagttttgtgtttttagtagagacagggtttcaccatgttgcccaggctggtctcaatctcttgacctcatgatccacccgcctcggcctcccaaaatgctgggattaccagcgtgagccaccgtgcatggccaaaaaggtaaatctcatagcatgtaaattacatgtcattaaacacacacacacacacacacacacacacatgaggtgggtgtggtggctcaggcctgtaatcccagtactttcggaggccaaggcgagaggatagcttgagcccaggagtttgtgacaagcctgatcaacagagcaagaccctatctctacaaaataaaaattaaaaaaaaaattagctgggtatggtggcatgcacctgtagtcctggctgcttggtaaggctgaggcaggaggatcgcttgaacccaaaatctgaggctgtagtgagctattattacaccactacactccagcttaggtgacagaggaagactccatctcttaaaaaacaaaaaaacaaaaaaaaaaaactaataaaataaaaacatgaaatccaaaccaaaaagagatgagaggggaggtaggcagagagagacagagggagagagagaccaggagagagccagggagagaggaagggagagaggcttggactgagtgtctgagtctccatacagacagtcagatcactggtatgttgtgggggtgcagttggggaaatgaggaaactccaggcatcagggggccccatttgagatgtaccatccagagtgtgagaattctaatgagtaggcaggggccataaggaccattttcttcctccctcccttccttccttccttccttccttccttccttccttccttccttccttccttcttccctccctcccgccctcccttctttccttcctttttcgtttttgaaatagggtctcactctgtcacccaagctggagtgcagtgacacaatcatagctcactgctgcctcgaactccttggctaaagcaatcctcccaccttagcctcctgaggagctaggactacaggcatgcaccaccacacccaattaatttaaaaaaatttaatagagatggggtcttgccgtgttccaggctggtcttgagctcctggactcaagtgatcctcccacctcagcctcccaaagagccaggattgtaggcatgagccaccgtgtccagcctctttataaataaaagatcagtgacacagaaaatggtttggttaaaatactttatatttcttcctaaactcttcttccaaagtaaaataaatatattttcagttataagtaaatttgctggaatgtttttccacctgctggggcaaaggtcctccccttccacccctgcctgctgcccccggtcctgtcgaggggcagatttcctccctcacagggcagacaagccacatcggggcagtgtctgccgctgcttccgaactccctgctcacggactgggagcggggcctctggcccctgagtgagctggggcaacagacttcagaatgtcgcagcccgagggagagtcacctggagagccactggggagacgctgatgtgggctgatgctggatgatggaaaacactgtgtttcgtgttttttattttgtcaggtgtgatgacagtataatgggatgatatgttaaaattcttttttttttttttgagacgaagtctagctcttgtcccccaggctggagtgcaatggcacgatctcggctcactgcaacctctgcctcccaggttcaagggattctcctgcctcggcctccggagtagctgggattacaggcgcctgccaccatgcccggctaatttttgtatttttagtagagacggggcttcaccatgttggccaggctggtcttgaactcctgacctcaggtgatcatcctgcctcggcctcccaaagcactgggattacaggcgtgagccaccgcacctggcctaaaattcttatcttttcatgtatctcaaaatatttagggatcaaatgtgtctgggccatgctggaaatactttagacaaagaaaacaggagagacaaagcagataaaacaaaatgttgataattttaaatctagctgatgggtatatgggggttccatttaatattttctctcctactcatatacgtgtgtttgtgtgtatgtgtgtgtatgcctttcaaaattctcattgaaaagtggctgatcggaagtgcaccctcaaagatgttttccccttttctccactaactcacttttttttttttttttttttttttttttgagaccaaatcttgctctgtcacccaggctggagtgcaatggtgtgatcttggctcactgcaacctctgcctcccgggttcgagctattttcctgcttcagcttcccgagtagctgggactacaggcatgcagcaccatgcccggctattttttttttttttttttttttgtatttttagcagagacagaattttgccatgttggccaggctggtctcaaactcctgacctcaagtgatccgcccgcctcggcctcccaaagtgctgggattacaggtgtgagccatcaatgcctggcccactaactcacttctaaatgatcttgttctctttgaacagaaataaaggatattatgatcttaccactttataaattagaatgatgaaattgagaaaaactagagatgactaagatgaagacagacatgaaatcgtgccaaaaagtgcccatgctgtatccagcagctgctgcagccacagaaatgctcgagttgtcagcgagggtactcactgcttgatcatctagcattgccagatactgtaaaccgccgcacacctatcagcagggcactggctacatcacacagattgctgtgccatggtttaaggtcacattgcagcagagcaggaagcatgtggctgggagtggcacggggccagctttcaggatgtatggtctggactgagctgcagtccttggggcctggacagctgctctggccctgagccctcctcccctccctgtggtctctccctttccatctctctctgctacatagcctcccttccctctctctgctctattctccttcccccatcccctttcccctcacccccaggtcaattttcttagatatctccaggcccaagtttggaggttcccaattagggtgcaggctggccctcaggtgcgtgggggtccaccttgtccagccatggctggccccagtgctacgtcacaatgtagggactgagagtggatgcggtggaggtgggcatttaccacactgtaagggatcagtcagtacagaccaggagcaggccgaatagtcagtacccgtgcagttccggaaaacccactcgttttgtgaagagcgtctgccagctcctgcatctgctagggccctgctgtgcctcctcccctctcctgccccctgggactccgcctccctcccctgctttcttttctcctggcgcttgtccccatcccacgctccaccgcgggatatagcaatgacttatttgtgtattgaggtcagtagatctcctctctatgaagacaggtccctcagggacagggctgtctgtgctggtggccgcagcagcccagcccctacagcctgccccacatggtagacaggcagctatttgctgagtaaatgaaggggtcaggggatcgctaataattttcattttatgttttatgctttccttttggtttcaactgttctgtaaagaagacattttatactagaaaataatattgctttaaaatgtaaatgtgcatggagcaacaggaactctctcattcattactggtgggaatagaaagtggtccagctattttggaagacggtttggcagttttttacaaaacaaaacatacttttactatacaatccagcaatcacactccttggcattggcccagatgaatggaaaacttaagtccacacaaaaacctgcgcatggatgtttatagcagctttatttataattttgtcaaaacttgatagcaaccaagatgttcttcagtgggtgggtggataaataaactgtggcacatccagacaacagaatattattcagtgctaaagagaaatgagctatcaagccatgaaaagccttggaggaagcttaaatgcatattactaattggaagactccagtctgaaaaggctacgtactgtacaatgccaactctatgacagtctggaaacagcaaaaccatggagacagtaaaaagatcagtgaccccccgccaggttcaatggctcactcctgtaatcccaacactttgagaggccgaggcaggtggattgcttgagcccaggagttcaagaccagcctggacaacatggtaaaaccctatcttctctactaaaaacacaaaaattagcctggcgtggtggggggtgcctgtaatcccagctactctgcaggctgaggcacgacaattgcttgaacccaggaggtggaggttgcagtgagccgagatcatgccactgcgctctagcctgggcgacagagcgagactctgtctagaaaaaaaaaaaatcagtggctctcataaaaacatcagtggctcccaggggttgtagaagggaggtgaacatgtggagcaggaagggctttccgggcagtgaaaccgctctgtatgattctataatggcggacacgtcattatgcatttgtccgaattctcacgaagtgcagcatccggaatgaaccctagtgtgcactgtggactctgggggataggctgtgtttacctaggttcttggacttaacaagtgcacccctctgtggggtgctgacgggggaggctgtgcctgttggagcggaacatatggcacatctctgtaacttctgctcagttttgctatgaacctaaaacacctctaaaagctaaagtctattaaaacattttaaaaagtagatttcaggctcagtgaggtgggagagggcggtgggggtgttcccaggcacagagggagcaggcacaccctgccctcgcaccctgggagaagctgggctggctgaacttggggaggcctggccctgggacctgcaggtagcctctggaatgcggacgtgcaggctgaccctgatggtcctgtgaatgccaaccaacctgccactcctgggctccctggcacagtcaccacaagtgtcaccccaggtcactcgcagatgcacccttatctccagaccagctggagacctggcctgaagctgagggttggcggcaggagaatggcccaggcaaaagttctcctcctaaagttgctttggaaggagggccggggagggccctcccggaccctggaagcatgaagacctccccactggagtgaagacagggagagagccaggcgtggcaggcacagccagggtgcgcacagaggatggctgcccggggcttagcatctgctcacctcatgaggttggcactgctgcctagacaacccatgtaataccccaggcctcaccattttggattgagagatgagctcagcgtcccctcacagggctctggagggtttagcaaaaggctgcggtgaaagtcacccggtccacggctgtctctgccacctgggactctctgcttcctttgcctgtgactctgcagccacttggcccggcccccagtgctgggcacccctctagatgagcgatttgccttcctctccgggtacagatgatgaaggggcctctcccggtgtcctgggtatttctggcaaccaaatggcccctgcccaggcaagagtcccgctaggaatcagcacagcctgcttgggctgagttcgtgggtggagggcatgagcttccgagaagcccctgcaggcgccaagctggggggccaccaagcccgttttccgccgtggctgcctgggtgcagcggcaatgcctgtggcgtgggctgctggcctggcctgtggggcagctgcaagtttcccttttaatggaaatctctctcttgcagccatacattgtgtttgactcgagtgtgtttttcttggctttaagaaacaggattagttgcactctttgtaatttttggtattaaaggtatttttaacaaatgcagtctgtatcgtgggaacatcctgaagttcctggaatgtctgtagtctaaagtcaagcctgttcccacccctggccttcctctttaaaggcttgatgttgttcgatgggatgtctatttttgttcatttaggtttcaaattgaagcgtgactagcactgggaaattggcattcccctgcagtcagctcttcttcctccagccccagatgtgggacggtagagcagaggggcaaaaggatcggacggcactgtgtgctctaggcagggacagctgaggggccaatgccctgcccctcccagccagaggaggatgcccccatctgttcactgcaccctccagtgggaaacgagcaaaacaagaggcaatgcatttgcagtcactacagtaggaagaggtattcgctttccaccagtaagtgacaaatcactcataagggagtgctgggaagggaagagcatgatccctttaaatgataccaagtggggaaaggaagtgctgggtagaggaggtcgtggtccctggctagggctccacccccacggacctaggtgaggacaggcatttttgtttgcctgcccaaatgttgcatttcccaagaccaccctggcctgccatgcccctgtcctgtgcctgtaaaatcccctgacattctaacaggcagacacacaacaggctggatgtggagagaagcggatcggcggaagaagacacaagcggctggacgtcaaggggagcacgctggcggaagagcacagcgacagaagagcacactgacagacgtcggcaggccacccaccctggcagaatgacacagggtttggctagggcagtcagaagagagcctgggccgctgagcgcccgactccaggggaaaaccatctcttgtctggctcccccatctactgagagctacttccactcaataaaaccttgcacccattctccaagtccaggcgtgatctgattcttctggtacaccaaggcaagaacccagatacagaaagccctttggccttacaacaaggtagacggtctaattgagctggttaacacaagctgccgatagagcaccctgtaacacatgcccactggggcttcaaaaactgtaaacattcacccctagacactgctgtggggtcggagccccacagcctgcctgtctgtatgctcccctcgaggtctgagcagtggggcactgaagaagcgagctacacccccatcgcacgccctgcgaggggatcaaagaaactcttcccatttcatcaccaccaacagcagcttgagatgacacccatttgcagcctcacagttccacgaggcaggaacttgaatgtggcttagctggatgctctgcttctgggtgtctcccgaggctgcagtcaaggtgtctgccagggcggtggtctcatccaaggctttgctgggtggggctgcccatccaagctcactcatgtgctctttggcaggacccagtttctctggctgctggaccaaggccccagctctcggctgtctctcggctggaggccgacttttgttccttgctgcataagccttccatagtggcagcttcctgcaccaaagccagcaagggtaagattctagtcttttgtagtctaatcacagtgtgacatcctcaatgtcgctgcgttctgttagaaggaagttactcaaggggtgaatacaagaccatgccttccatgaggcaggatcgtggggccacctcagacactgtctgccacagaagcgtgtagaaacgatccaccccttgctcatatgtgcattcaccagaaggtgctttggcccctggtccagagcgggagcaccagggtgaggctctgaccccctgcaatcctttcaactctcccatccctccatctcctcctctttagaacgggggtgatggaatccactgtgcagttttgtaatgtttttaaattagaggttgtattgggccattcttgcattgttacaaagaaatacctgaaactggataatttataaagaaaaaagctttacttggctcacggttctgcaggctgtacgggaagcatagcagcatctgcctttgaggaggcctcaagaaaacttccagtctttgtggaaggtgaacgggccgcaggcacagcgcatggtgaaagcaggagctgcggtcgcgggggcgggggatgccacacacttgaaaatgaccagatccataagaacccgctcactattgccaggacagcaccaagagcatagtgctaaactattcatgagaaaaccacccccatgagccaatcacctcccaccagacctcacctccaacactagggattacatttcaacatgagatctggggagagccacacatccaaactatatcagatgggatgagaaataatgaagagctggccttggcattttgctcatagtgggaacccagaaatccttgaatgaatgaatgagtttcctgttgacacaatataagtgctatgatacaaatgtatgtgtccctcccaaagttcacatgctgaaacataaccccaagttgatgctattaagaggttgggcctatggaagttgatggccatgggggcagagtgtccttataaaagacgctccagagagcttgttcagcccttctgccatgtgaggatgcagccaataaggctgcttggaggcagagagcaagcaagactcaccagatacaaaacctgccagtgtcttgatcttggacttttcagccaccagaaccataagcaaaaaacttctgttgtttataaactatccagtctcaggtattttgttttattagcagctggacagcccaaggcagggacaaagccccatttggagactttggcagcaagaaatacatgagaattccttcagaatatgtggattcctggggaagtgaaacccagctcagcccctagggagtgcggaaggtcaggcctctagcttggacttggccctttgttctagagaattagacactcaacaaagctccgcggtgctcacagctgaggctggagaagggacaacccagatgaggaaggaacaacatatttttttttctggcttctactttattttattttgagacacagtctcactctgtcacccacgctggagtgcagtggtgtgatcttagctcactatagcctctctctgcctcccaggctcaagcaatcctcctgcttcagcctcccaagtagctgggactacaggccagtgccactacatctggctaatttttaaacattctttatggagatggggtttcaccatgatgcccgggctggtctcaaactcctgaactcaagtgatccacctgcctcagcctcccaaagtgctgtgattaacaggtgtgagccactgcacctggcctctgtcttctattttaaaaaagaaacttttatgtggttataaaagtgatgctggctagcaggaagaccctaatggagaggctagaaaggaatgcaatcccactgcccagagaggccggcctggctgtgccagaatcatagagtgggggtacactttcacctggcacagccaagcccactcagacctgcccagtcagagctggggcagagctgggcaggaggaggttggagacaccccctgagtgattctgacaacctcctggttgcaaagtgccctctatgcagcatctcccgtgggtgaggtcaggctcttggagcagttttctttgtctgcttttccccatgcagcattatatcatccacattttccagtgatgttctctccctgtgactctcacacctgtaatcccagcactttgaaaggctgaggcaagcagatcacttgaggtcacgagtttgagaccagtctgggcaacatggcgaaaccccatctccataaaaaatatttaaaaattagccaggtgtggtagcaccgggctgtagtcccagctacttgggaggctgaagcaggaagattgcttgagcccgggagacagaggctatagtgagctaagatcacaccactgtactccagtctgggtgacagagtgagaccgtgtctcaacgtaaaattctccaggtgttctcccagcccacagccctcgtcaggttggcatatgacattgtaggccttttcttctgtgtttccataattacatatttacgtggcaatatagttttggattgtttttttctctttatataaatggtatcataccacaagtggcatcctgtgtcttaccagtttcccactgtgatatgtcttggtattttttccatggttggacatgtcactgacacatattcttttcattgcttcttggttttgaggttccaaggttccgagattccatagttccagggttagatggttccatgattcactggttccaaggcccaaggttacatggttcaaaggttccaaggtactatggttccatgcttccaagatgcaatggatccaaggttccaaggattaatagttccatgtttccaaagttccttggctcaaaggttcaatgttatcattgttccaaggttccatgtttccaagattcagtggttccaaggttctatgattccatggttccaaagatcagtgatttcaccgttccaaagctacatggtttcctggctccaaggtacaatggttccaaggatccaaagtaccgtggcttcatagttccaaggttccagggttcactggtcccaaggcccaaaattacatagttcaaaggttccaaagtactgtggtttcatgcttctacggtgcaatggttccaaggttccaaggttcaatggttccatccttccaagattccaagattccattatcaaggttcagtgttaccattgttccaaagttccatggtttaatgggtccaagattcaatggtttcaatattacagagttctaaaattcagtggatctgtggttccaactttacaaggttgtaagattcagtggtgaatggttccaaggttccaagtttacagggtttcaagtttacagggttctaaggttctgtggctctgtgattacaaagttacatggtttccttgttccaagattacatggttccaaggttccaaggtttcttgattccatggctccaaggttccatgtttccatacttccatatttcagttgctccaaggttccatggtaccaaggtttcatgtttcccggtttcgaggttcagtggttctgtggtttcaagactccacggttgcaaggtttcatggtcccatggtccaaggttccaaggctccaagtttccaaggtgccatggtttcagagttcatggtatcaaggtttagtggttccttgcttcccagtttccctggtttgttgcttccaagttatcaacatttcatttttcatttgcctccacctatttgtagacactcagattgcatccggagattttgctcttatcaacaacgccaccactatcagccttgctttttttttccttgtgcacatttaggagtgttcctgaagggcaaaaatcaggagcagaattgctggatcccaagaagtaatatgtgaaatttaatcaatagagccatattgccctctaatgcatctgtatcagttgcagtcttccagcagtgtatctgagtaccatttgctcgtcatccttgctatgacacaatattatcaaactttggtaatctttttttttttttttttttggagacagaatctcactgtgttgacaggctgggatgcaatggtgggatcttggctcactgcaacctccgcctccaggttcaagcaattctcctgcctcagcctcctgagtagctgggattacagtcacgtcccacaaggcccgggtactttttgtatttttaattgagatagggttttgtcatgttggtcaggctggtcttgaattcctggcctcaagtgatctgcccaccttggcctcccgaacttctgggattacaggcatgagccactgtggccggccaatctttgataatctgacggatgacaagaatatctcattgtaatttttgtttcacttgagtttgaactcttttacaatatgtttattgaccacttgtgtttcattgttacctgtgaattgtctgtttttattatgtaggtggtcttcttgttgctatgtaaagattcttttttttctttcttttcttttttttttttttgggacagagtctcgctctgtctcccaggctggagtgcaggggcaggatctcagctcactgcagcctctgcctctcgggttccagcgattctcctgcctcagcctcctgagtagctgggattacagttgcctgccaccacgcctgactaatttttgtacttttagtagagatagggtttcaccatgttggccaggctggtctcaaactcctgacctcaagtaatccgtctgcctcagcctcccaaagtgctgggattacaggcataagccaccatgcccagccataaagattctttatgtgttctattaccaattctttgcctttgttatacatgttgcaaacattttctcccagtccatcatttctcttgtagctctgtttttggtgagttttatgtattgcctgatgtatcagtattttctctctgggttcagaaacttatgtattgtattctctacttcaccaacaaagtttcctgtttttttcttttcttttattttttttggatggagtctcactccgtcacccagactggaatgcagtggcacaatctcggctcactgcaacctccacctcccaagttcaagagattcttctgcctcagcctcccgagtagctgggattacaggtatgagccaccacacctagctaatttttgtatttttagtagagacgaggtttcaccgtattggccaggctggtctcgaactcctgacctcaagtgatctgcccatatcagcctcccaaagtactgggattacaggcatcagccaccatgcctggcctattttcttcttttgtatctcatcagtattgatgtccaccagccaaagaccatctgtagtcaacaaagttaagtttattgctttgttgcaagtgagcctgcacatctaaaggagtgggtctggggacagagttagtcataggatgtcctgtcagcgtttggacagagtttgttaactgagggtcttactggaacaacgatgagtggtcttgtctttatgagttcgttttgttttgttttagagacagggtctcactctgttgcccaggctggagtgtagtgatgtgatcatagctcactgcagcctcgaaatcctgggctcaagcaatcctccctcttcatcatccctagtagctgggacttcagctcctgtagaggcggggtctcactatgttgaccaggctggcctcaaactcctggcctcaaggggtcctctcacttcggcctctcaaagttctgggattacaggcatgagccaccgtgcctggcctggtcatgtgtgttcatgggccaatttgtccatggcttattttaggacacatggatgtgaatgaactggtgttaaataatgacgcccactgtggcttgatctggcacagttgatgtgttttgtgagtcagggtatatttcgcaagctgtggtttctgttttaatcctcagtttccccaaacagactggatgcagcaggacccgtttacacctgagctgtggctttcccagtcattttcctggccagccttggctgaaggaccagctgttctcttctgagcgtgccatcatcgatttttgtgccaagtcaaatggtagcctttctgacgcctgcaacatccagcccccttgttctttctgttggatcatctgacaggacatcagctttgtggcagcattccaaaacgtggatatgcacttggctactgcaacacagataaatactaagacaagagtttttattcacaagtgaaacatatctcctatgttctgtgttctattaggagctttctcggatgaccaagtggtttcttccctttgatctggatgagatttgttcaactttgccagagtttgaagaattagttctgtatctggtgattgtcaagagttagggtcttggaagcaccaacaatgggggtgtccactggcaatggagtccctgaatccgcagagagggaaaacagccaggaaaataaaaaccagggacatgcctcatgcagagaagccccagcagtgggcagaagcgttctagtccgctgatctctgctcgtggacccctcggtcctgggaaccctgacccgcacgaggtccatggtggtggcattggcactgcccctaattgaattccctgtagtaccagtagccaccagagcctgggacagtccttgactgaggttctttagatgtttcatccacacggctcagttcccgagctttgtggatagcaggagccttggggagaatgtaaataaatgttctgtaaatgtcagttcggcccgtcaggtctagagtgtagtctaactttgatgctgctttgctcattttctgtctggatgatctgtccattaataagagtggtatgttgaagtcccctacaaaactctaataggtagtaagaataagtgttttttttctggatttaggaaagacaaagtcaaagaattgtcagagaacttaatatatgaataaggctagaaatggcaaattatacatacagataaatatatatagagaaaaatatataaatatatataacaaaaaatttttatatatgtatacatatattttccaagacagggtctcactccccttgcccaggctggagtgcagtggtgcagtctcagctcactgcagcctcaacttgctgagctcaagtaatcctcccacctcggcctcccaagtagctgggactacgggcgcgtgccatcgtgcccagctaattttttgtatttgtagtagaggcagggtttcaccaatttgcccaggctggtctcgaacccctggactcaagtgatctgcctgcctcggcctccaaaagtgctggaattacaggtatgaagacttcattttctttgcagtgattttaggataagttaagggtggagccagaataaacccagctgtattaaaccctgaaattccaatcctttcctctaatagctttaacacaatgtttttacttttagaaatgagatctcactctatcacccaggctggagtgcagtggcatgatatagctcactgcagccttgaactcctgggcttaagcaatcctcctgcctcagcctcctgactagctgagtaggcacacgccacgacgtcttagttttaatcttgtgctgtgtaagtagagctctttaatcagactgcaatgtatttttctgtgggatatatgatccaaacctttgtttcttccaaatagatagccagctgttgcaattttagactggtgtgaccatttttctgttcataagaacactttagagaatatcaagcatgtgtatctttctgttcacttacgctcattttctggagttaaatttcctgaactggaattactgggtcaaaggtatgagccttttgaggttcctggtgcatgttaccaattgttttccataaaggttgcacccacaggcagaagcatccatccttggatattctaattgtaaaagatatgcttttctagtgtggataagcaaagtagcttaacattgcttcaatttactcatctttttttatttttattttttatttttgagatgaagtcttgctctgtcacccaggctggagtgcagtggcactatcttggcttgctgcaaccttcacatcccaggctcaagtgattctcctgcctcagcctcctgagtagctgggattacaggtgcccaccaccacacccagctaatttttgtagtttttagtagagacggtttcaccatgttggctaggctggtctcaaactcctgacctcaagtgatctgcccacctcagccccccaaagtgctgggaatacaggcctaagccaccatgcccagcccaatgtacacatctttaaaaattagtgagaggccacttcatacccattgggggtgctactatattttaaaataaaaacagaaaacaagcagggcatggtggctcacgcctgtaatcccagcactttgggaggctgaggtgggcagaccacctgaggtcaggagttcgagaccagcctagccaacatggtgaaagcctatctttactaaaaatacaaaaattagtcaggcgtggtggcgggcacctgtaatcccagctactcgggaggctgaggcaggagaatcgcttgaacccaggaggtggagattgctgtgagccgagatcacaccactgcgttccagcctgggcagcagagcgaaactgtctcaaaaaacaaaacaaaacaaaacaaaaaaacagaaaacataagtgttggtgaggatgtggagaaattggaacccttgtgcattgctggtagaaatgcaaataatggagccactatgggttcctcaaaaaattaactatagaattcgcatttgatccagcaacccatttctgggtatagacacaaaagaattgaaagctaggactcgaacagatactcgtgcacctattattacaacagccatgagatggaagcgatgttattcataacccaaatgtccattgacagatgaatggttaaacaaaatgtaatataaacttacagtggaatactattcagcctttaaaaaggaaggaaatcctgatagatgccacaacatgaacggacctccaggacatgatggtcagtgaaataagccagtcgcggaaggacagtttctgcatggttccacttacgtgaggttcctacagtagtagaaatcatagagatagaaagtcgaatagtggctgccaggagctgggaagaggggacggtggggagcagttgttttatggggacagaatttcagtttgggaagatgaaaagtcctagagacggatggtggtgatggttgcacaacaacgcgaatgtgcttaagcccatcaaatctcacgcttaaaaatggttaagacgggccgggcacagtggctcacacctgtaatcccagcactttgggaggctgagacaggcagatcacaacatcaggagattgagaccaccctggctaacatggtgaaaccctgtctctactaaaaaataaaaatcacaaaaaattagctgggcatggtgacgggcacctgtagtcccagctacttgggaggctgaggcaggagaatgacttgaatccaggaggcggagttgcagtgatccgagatgcaccactgcactccagcctgggtgacagagcgagactccgtctcaaaaaaaaaaaaaattgttaagatggacagtctttgtgtgtgtgtgtgtgtgtgtgtgtttgtgtgtaggccgggcacggtggctcgtgcctgtaatcctagcactttaggaggccgaggcaggtggactgcctgagctcaggagtttgaaaccagcctggccaatatggagaaaccccaactctactaaaagtacaaaaaattagccaggtgtggtggtatgtgcctataatcccagctactcggaaagctgagacacgataatcacttgaacctgggaggtggaggttgcagtgagcagaaattgtgccactgaactccagcctgggagacagagtgagactctgtctcaaaaaaaaaaaagactcaccctgatcacagctcagtgcagcctcaacctgctggagcaatcctctcacctcagcctcccgagcaactgggactacagctgtgggccaccatgactggctaatttttaattattattattattttttgagatgagatctccctatgttgctcaggctggtcttggactcctggactcaagtggtcctcctgccttggccttccaaagtgcagagattataggcatgagccactgtactcggcctgtcatgtatattttatcacaataaaaaaatctgtgagaggaccatttcttccaatgttgattggccaatcctatttttgtgtgtgtgagttttttcttcattttctgagcccacttatgtccgagctctgagtcccaggaggccagtggaggagggaagaagaggactcggcctgagggtgacatgagacttgaagaggctcctggtggcataggggaggggacagcccaggggaggcagttccgtaggcctggcagtatgaaccccaggctgaggcaggtgctaaagaagaggccatctcctcgaggccctgaccctggaaggcatttgctgaacacccagtgcctggtgacatttggggtcctgagcccagccagcctccgaggatcagccctgcctgttatgcgcggaatgtttgcatccctccaacattcgttgttgaaattctaacccctaggggggtggtactagaaagtggggcccttgggaggtgaagaggtcgtgagggtggagtcctcatgaatgggagtagtcccctcatcagaggggcccggagagctctctgccctctgccacgtgaggattaaacatgaagtaaaaaatctgcagctggaagcggctcccaccagaacccaacaaagctgcgtcttggtctcagatttccagcctgcagagctgtgaagaatacagttctgtgtttaagccactcagtttacagtattttttaatagcagtccaatctaacaaagccaccacccctggctgggccccagctagacagaaagcctgtcagggcactctagggtttaactccccaagctcagagagcgtgttggggccagctggtgtcccacacctgggccacttatctgcaggacagggtgatgggggctcccccgtgtgtcgtgacctctgggggaggttttctagaaagtgcatacacttgctctgtacgcatctccaccctgatccagggtgctcccatctctgccccaagcacctgctccagaggacgcatggtcccaccgtccagggtcaagaaccccggaccaggccctggcccggttctggtcaggctcggccaccagggggcggtgtgggctgcaggaggctgctgtccctggagcttcccagttccagaccaggaccccaccccactgggtgggcgtctccaaggccctggtggattctgtaagctcggacccgttaatagaagtggttctctattgtcccagtcgcctaaaatgctggggacctctcaggtgtctgctgatggaaaggcagccagagccagccaaggcaattcccaagcccaccgctcagccttgcagaactgactgcacaagggtcacccaggggaaatggtttctaaaaatacagggacttccacttccaggaaaattgagtagaagtacttttccctgttcctcccactatgtacggctaaaagcctggacaccacacagaaagcaaacataagcggattctgaaaggtgaagagaagagcagagatccgtcagggacctcaggacccaaggatgacggggcgggcagctccatgtggtttcttttggcctcatatatctcactcctggagctgaagaagccagcaacctggaaacgccaacagacacagacaaaattactccaatgaaagctgctgtgtctagccaaaggaccaggaggcagcagcctcgcaaggtcaaaacgtttaggcgataacctgtctactccagccatcaccaccgaaacaccctcggccactccagcaaaggctgagcgggagcctaggctccccactttgggaagccgtggcaaggaaccccaacatctccccctgtggtgtcagagaggccaaggagggagccgagaccgccgcacccacccctgacccataccccattgtggaacagcctgagcttccaccccatctgccagtaatgccgccctctccccctccctgctgggggtgggggttggtgtcagaggaggcaaagcgaggagcctggctcttcactactactcagtggtaacgaggccaccccaatgggctgtcagcagaaaccacatggggagccagaccctgcccagagtaaagagaaaaagagctcccttgggtataaacggagattgagtggggaacctggacttttttccaccctgcagtaacaaggggccagagcagcgtcaaaaaaacaacaacagcacaacaccacaatgtttacaaaagcagcaatagaagactttggggccaggcatggtggctcatgtctgtaatcctagcactttgggaggccaaggcggctggattacttgaggccaggagtttgaggccagcctggccaatatggtgaaaccctgtctctactaaaactctaaaaattagctgggcgtggtggcgcacgcctgtaatcccagctactcaggaggctgaggcaggagaattgcttgaacctgggaggcggaggttgcagtgagccgaggttgtgccactgcactccagcctgggtgacagagcaagactctgtctcaagaaaaaaaaaaaaaatagagaagactgatgggtgtgtttattaccttgattgtggtgatggtttcatgggtctgtatagacatatgtcaaaactcatcaaactgcctattttaaatatgtagtttcttgggtatcaattatacctcgataaagctgtttgaaaaacagaaaatttaaatcagatccagagtctcataacacaaaaaatgtccaggtttcaatagaaaaccgctcattaccaggaagatggttctcagtatgatgcaacggactgaaactgttgaatgcaactaagtgaaaagggacaatcagtagatgccaacagtaggtggcaaagacgttagaattagctcacaaagattgtaaagcagccatcataaagatgcttcagcaaacaactaagaacgtgcttgaaacaaatgaaaaaatagcctcagcaaagaaagagagagaatatcttaggaaagaaattgaagatataaagaaattggaatggaaattttagaagtgaaaaatacaataactgaagtataaactcagtggatgggctcaagaacaggatgaaggggacagaggaaagaaccagtgaactggaagacagaacaatagaaagtacccagtctgaacaacagagaaaatagactgaaaaagaaaaaaaagaacagtctcaggtatatgtgggactgcaacaaaagacctaatatttgtgtcattggtggttaagaaagagaggagaaagcgtgcaaggctgataaagtactcaacaacggctaaaactccccatatttggcaagagacacaaacctacagattcagaatgaatcccaaacaaggaaaacccaaagcaatccatgccaaggcgcatcacagtgaaatttctaaaaactaaggacaaagcaaaaatcttgaaaatagccagagaaagcaataccaataccagtaccaatactctatagggaaaaaccatttgcattactgcagatttcccttcgggactgatggaggccggaatgaagtggcacgatatttttcaagtgctgaaggaaaggaaccatcagcccagaatcttatatgcagtgaaaatatccttcaggaatgaaagggaaatcaagacattctcaaatgaaggaaaactaagagaatttgttgccaaagacttacccaaaaacaccagctgaaggaagttatttaaatgggaaggaaataattaaataaggaaggaaggaaaaaaacctaataagtaaaaatgtgagtaaatacaataggcttttcttctcctcttcaattttgtaagttatgtctgatggctgaagcaaaatttattgcactgcctaatgtgattctaagtgtatgtataggaaagatttaagacaattacattataaatggggcaggataatgggatacaaagagaggtaagtttcctacccttcactcagactgaaaaaatgacaccatcagtagattgtgataagttgtatataatgtggaacatccactaaaaggctgtacaaggagctacattcaaaaacacgatggagggccaggcacagtggctcacacctataatctcagcactttgggaggctgaggcagaaggattgcttgaggacaggggttcgagaccagcctgggcaacatagcgagacccttactccacaaaacattaaaaaattagccgggcatggaggcacatggctgtgtcctagctacccagaaggctgaggtgggaggattatttaagcccaggagtttaaggttacagtgagtcatgtcactccagcctggggaacaaagtaagactctgtctccaaaaaaaaaaaaaaaaaaatgcaaacaaaaaacaaaaacaacccacactattgatcaatcaaaatggaattctaaaaaatgtttaactgataagaagtcaggacaaaggaaacagaaacaaaaaacagggagcaaacagaaaacagatcagaataaaatggtacaattgctgggtgcagtggctcaagcctgtaatcccagcactttgggaggctgaggtgggaggatcatgaggtcagaagatcaagaccatcctggctaacacggtgaaatcctgtctctactaaaaatacaaaaaattagccgggcgtggtggcgggcacctgcagtcccagctacatgggaggctgaggcaggaaaacggcgtgaactcgggaggtggagcttgcagtaagccgagatcgcaccactgcactccagcctgggcgacagagcaagactccgtctcaaaaataaataaataaataaataaataaaatggcacaattatatcctaacatatcaataattacattaaatgtaaatgtcttaactcaccaattaaaagagattggtaagatggattttaaaacatgtatcaactatatactatctacaagaaattcacttcaagatgtttcacacagatattaatcaaaggaaagcaggagtggctatattagtatcaaatgaggcagacttcagggcaaagaaacttaccagggataagactgacatgcaataataaaagggtcaatgcaacaagaatgcatagtaatcctaaacatttatctaacaaacaacagaactgcaaaatatatacaacaaaaagggatagaactgaaaggagaaatagacaaatccactattgtggttggatacgtcaacactcctctctcaacaattgatagatcaactagacagaaaatcagcaagaaaatagaagcacgcaatgatatcgtcaaccaacaggatctaattgacatttattgaacactttattccaacagcagattatcctttctttccaagtgcccacgaaacatataccaatatagaccatattctggggcacaaaacaaaccttaacaattttctaaaaattgaaatcacatggtgtgggttctccaaacacaatgaattcaaactacaaatcaacagaaagataacagaaaaacctccaaatacttgaaaactaaaccactcatttataagtaatccatgggaaaaaggagtttcaagagatattttaaaaaatacattgagctgaatgaaaatggagtacaaatgtcaaaacacagaaaaagcattgtggatggggaaaatttatagcattaaacacatatattagaaaagaggaaaagtctcaaatcgataagctcaaaaacctcaagaaactaggaaaagaagagcaaaataaacccaaggcaagcagaaggatgaaaataataaaagataagggcaaaaattaataaaatccttataaaaataatagagaaaatcaatgaaagaaagagctgattgtctttttttgtggggggagggggacggagtcttgctctgttgcccaggctggagtgcagtggcgcaatctcggctcaccgcaaactccacctcccaggttcaagcgagtctcctgcctcagcctcccgagtagctgggactacaggcacgcaccaccacgcccagctaacttttgtatttcagtagagacgaggtttcaccatatcggccaggctggtcttgaactcctgacctcgtaatcctcctgcctcagcctcccaaagtgctgggattacaggtatgagccactacacccagccaaaagctgattctttgaaaggtcaataaaactgacaaaactctatcaatactgaccaaagaaaaaaaaagacatagattaccaatatcaggaatgataactctactctatacatataaatttgacaacttggatgaaatgaaccaatttcttgaaaaatacaaactaccacaacttacccaatatgaaaaagataatttgaatagggaatttaattaataattttagaactcctaaaaaaagaaatctccggactcctatcgtttaaatagataattctatcaaatctttaaagaaaaatttatcaccactgttccagaaaataggtgaggaaagaagactttccaatttgttttatgcagctggaattacagtgataccaaaaccagacaaagatagtagaaaaaaagaaaatctcagaaaaatatccctcatgaatatagaccaagaaaatatttaataaaatattagcaaatagaattcagcactacatacaaataattgtacaccattaccaagtggagtttactcctggaatggatgactggttaaacattcaaaaagcaaacaatgtaatccactgaattcacaggctaacaaagaaaaatcatatcaattgatgcacaaaaagcatttgacaaaaatcggctgggcatggtggctcacgcctgtaattccagcactttgggaggctgaggagggtggatcacgaggtcaggagatcgagaccatcctggctaacatggtgaaaccccatctctactaaaaatacaaaaaattagccaggcgtggtggcgggtgcctgcagtcccagctacttgggaggctgaggcagaagaatggtgtgaacccgggaggcggagcttgcagtgagccgagatcatgccactgcactccagcctgggcgacagagcaagactccgtctcaaaaaaaaaaaaagcatttgacaaaattcaacactcattcataacagaaattctaaaactaggaataaagggggaactttgtcaactttgtaaagggcacctataaaatacctatagctaatgtgatactctttttttttttgagatggagtctcactctgtcacccaggctggatggagtgcagtggcgtgatctcagctcactgcaagctccacctcctgggttcacgccattctcttgcctcagcctcccaagtagctgggactacaggtgcccaccaccacacctggctaatgttttgtatttttagtagagacatggtttcaccatgttagccaggatggtctcgatctcctgaccttgtgatccatccgcctcggcctcccaaagtgctgggattacaggcttgagccaccgcgcctggccagctaatgtgatacttgatggtgaaaactaagttctttccttccaggatccaaagagaagatgcctgctctcaccactcttactcagcacagagctgggagttctagccagtacaataaggcaagaaaaggaaataaaaggcacacagacaggaaaggaagaaacaaaactgccctcatttacagataacatgattgtctctgcatagaaaattccaaggaatctaccctcaaaaaagccctcctagaactaataagtgagtttaacaaggtcgcaagacataagataaacgatcaaaagtcaattctatttctacatgctagcaacaaacacatgggcactgacattaaaaatacaataccatttaaaatccctcaaaaaatgaaacacttaggtataaatctaacatatatagaacataggtatgtgctgtgcactggtagcctcagctactcaggaggctgagaggggaggatcacttgagcacaggtgttcaaggctgcagtgagctatgatctatgccactggactccagcctgggtgacaaagtgagacctcatctctaaaaagatttaaaaaattaaattaagtttaaaaatgcagaatttgaacactgaaaactatacaatactgataggaaaaaaaagaattgaagtttttattgatccctgcaacaactggcataaatcttcaaagaattatgctaagtggaaaaagccaggcctgaaggatgatatactatatgattccatgtccacttacataacactgttgaaatcaacattctagaaatggaagacacatcagccattgctggaggttaggaaagggcttcggtgggagggaggtgcgtgtgaccgtaaaagggcagcaggagggagtctctggtgacagaaatatcccgtatcttgaccgtaccagtgtcagcatccaggctatgatgtcctaccgttgcaagatggtaccattgggtacaagggacctctctgtgttatttcttacagctgcctgtgaatctacaatgatctccacagaaaaaattcaattaaaaaatattttaaagcacataacaggcagtcatgtgtaatttgggtcacgtagaacaagtctggatcatgaagtctgtgaggctggtgtacacttaactgagagtgtgtctagctttaaaccggtatctgcatttaaaaaaaaaaaaaaaggcagagtcgggggccactctcagagagcactattaggtgctcaccggcagaacccagacattgcattttcaaagcttttaagcttttcagctgcactctgaggaaccggctattgatctgtgtccttggtgcacagcccttgcacttctttctgcccccacgccctgcggcccctctcggctctgaacaggggccctgctctctgggactccacatccctgcaaaatttgtctccccttccctgggttcctcccccggggctgagctgaggacaagggcctggcctcctccttggagaaccccacagcaccctgcatttcggcgtggtccatgggctcttctcaggggctcctcacgttgtgcaaaggggtaagggagcagggccagctgcagatctccctcccgctgtgacaaggacatcctagtcgaagagcccgtttatcttcgctcttaaggccaggctctctcaggtcattgttgccaaagaaatgaattgcagcacagctccgcaggtccctgcacaactggggcaagggctggcactgggccagcgggaacctgttggggaggctgcaaggtgcttctctgcatccaaggctgccacaccctgtgcacactgtggagctgggtggatggggtgtgctcaggaggggctctcggccctcggctgggagtcagaggcgtggtgggtggggcggggaggggtgtcacagctgcagggcagccttgatgtctgcacttggctttttaatttgtagtcacagccaacaagtgtggaaaccgcctcaggaccggcttgagtggagcggctgcgggagttacttcatgactgtggtctcacgctgtgtttcgccacccatccctgcctggcctggcttccttccttcctcctgggtacgttggcccttggctctctcctcattaactggcccctcggaccccggctggccagctgtctgcagcctcctgggtgacaccttcacccctgcctcctcgggggtctgctgccgccacatcaatctccctaacaccctgggcatgccacccctctggagacctccctagtctctctcgcagggcccccaacctgctcagcccaggcccactgccctctccctgcccggacacgtgctcccgtggcccggccgtgcctgcccacacacctgccctctctgaggttcacatgtggcatccaggggcccttccccaacagctctgcctggtgcagcctccccctcagcctcctcttccccccgagcagggtttgcagaggcccagaggctgccgggatgagtagatgttgggatcctgcttactgggcgtgtcttatcccccagagcaatggccttggaggtcagggacccagcatggccatgctggcttggggtttaggagctgtctcaccagagccccgcctcagcccacagccccgggcctgtttccttgaaggctccccagagccccatgcctggttttctggccagagcccttggcagtgacccctgctctccgcctgcagctctgggcgtcctctcagccccaagccctgataggtgccccctgtctctgtgcctgcagccttcaggagtggcccacacattggcttttatctctgggctctctgtcacctcctctccctcctgccaccctctgctcacaggctgcgggtgtggggcatccaggagctggccggtggaaagaggagcaggtgcccttacgcagtggggagcagacacacttgtgctgcttttcccttggggcttggggtggccactggggcaggacatgaggacagaccagccctcgtccccccagtgcagggggcagatctcactgccaggtgaaaccctgctgaccatccatgtggacccctcagcttggctggatgcaggaggtggttgcacagttgcaggtggggcatggagggagtggagcagccccttaccccaacacaggccccattcctgcttaaccggatgttccgaggagaagcacagcccaacaggtgtgcacaggaagctcccatcagtgctgtcctgggaaaggcccatcctgaatgaagtgtgttgctcagatccgaagagcgctgcatcttcacaggtcagggtggaaacctcctggtgcacggcccgggaggggcacccgtggcagggccagcccctgtgaggctgcacagatgagctcgagcagagagtctggggccggccacatcccacgtccgaccctgagctggggccctgggggagcccctgtggctttcgtaccagccacgcctgtatgtagagagctgagtgtctgctgtggaagaccacgagtcacatggcagacatgggcactcggcccaggcgatgctgacccatccatcagctcctacaggaccacaagctcccgttgtggtggccagagactcccaatggccacagacccactcagggctctctctggggtcttccggagaaaaggaaagctcaatgagctccttaaacctttcacttcaagttgttgcttttaaacattttgcttcgtggcctttcttgctccttctgtaaaaatctacattgtgctaccatttttttttttttttggcaaggtgtcactctgccacccaggctagagtgcagtgctgtgatcatgactcactgtagcctcaaactcctgggctcaaaggatcctccagcctcagcctcccaagtagctgggactacaggtatatcccacagcatccagctaattttttgaaaatttttttggtagagatgaggtcttaccatgttggccaggctggtctcaaactcctgggctcaagcgatcctcctgtctcggcctcccaaagtgctgggattacaggcgtgagccactatgcccactcaacatagtgattttctaactccttcatttcttctccatttagtagttggctttccaccgtaaggaaaactgcccagtctcccctctggctaccagtgaaggcttgtggggttttctttgattcggtgagttatattcagtggctgtggggcttgtttggatgctggctgaccggccccgtgtccctgtcatggtggagcacgcccttgcttcctggcaccaccgctgcacccggctcagcctgcactttaactgctgcagcgctggaggcagccacttccctgaggagccctgcttccttttgtttgtttgtttttgtttctttgctttgagacggagcctcattctgttgcccaggctggagcgccctggcaggatcatggctctttggctcagcctcccaagtagctgggactacaggtccccaacatcatacttgattacatttttaaaattgtttatagagatggggtctcattatgttgcccaggctggtctcaaactcctgggcttaagtgatcctcctgccctggcctcccaaagtgctgggattataggcgtgagccaccacgcccgaccaaggccagctttcttagaacagagtatttcttccacactggggtccaggcatgagttgtgctcactttaccatggtatcatttagatcctagaaaaaaattatttgtgagattattataatatgtataaataaatatacaattaataatactattaaacatcattgaattgtgattatattattaatatagttgtattattaatatgtgattgtactattaattttaattatcgtgtaattagttataatgcatccataataactcataccatgaattcacagtcactcctagtcctgcccggccctgcaggctcctccttgtgtccgtcattccgtatctgtacctccttctacaagagagccctaacttctaacagcatcactatgtctatcatctatttagccctccaaacacacaagacacttccagaatcttcttattctccagaggaaaatgtttcatcaaaacaccagaggcagccagcattttgacaagaaaacacaacaaacttcatttctttggaaatttgatctaggaaaatgtgtctctctcattttgctaatggatgtctgtttatcagtcagagaccatgaaacgactccttattttgaatatcagattttcttcttattctcaaacctcaaaacagcttggtaataatttatttggaaattatccgaaaggtaaaaataaaaacagaagcaagtaatatgccttgttactgctccttaattaggtaagagcctcatttcttgggctgctgggatgtaaattctgcataaaatggctggctttctttttaaggctttgcagcagtgttaacattcggctgccaactaagtcgattttaatcgcctttacaggaaccttcactttttctgtttgttccattccactctttcctcagtggataatcccgcatgttaagattcctgtgcagccgagggaggcggcttttggccgggagcttgtgctctgggtgtgagcgtggctgttgggaacgccttctgctcagaattccgtggtctcagcagatcgttcagtctagccactgggacggggccgaccgcacactgctggacctctgagcggaagatgtgtgaggttaggagggaaggaataaacaaagtcgccttcttccctgctgacctgccttggtatgtcaccattactcagctccttacagaacaggagcttcaagctttcaccggacaggctggcttcttcccgggagcccccgcccaaggtggggcctggtggggtggggccaccatcgctgctggaagctttagctcttttccctcagcttggcctcctttggcaactaattttttaactttttctaataggtaacagagtcccaagattccaagttccaggagcatgaaaggactcacttgtggagattcctgcctggggctcccacccacctaaggaatgccatccttgtcaccggctcacggggcagctctttggtatccttccagggtggtgtgtacaagtacaggcacatggatgcatggatgcatgagcatttttttcttttgccgacatattaatacacccggcagcactctaggcccattggcctgcaacttttcatttgattgatttttaattatttacttttttaaaaaattgtagttaaatatacatgacatatatttaccatttgagtcttttttttttttttgagatggagtcttgctctatctcccaggctggagtgcagtggtgtgatctcggctcactgcaacctccacagcctgatcctgggttcaagggattctcctgcctcagcctcccgagtagttgggattacaggcgcctgccaccatgcctggataatttttttttcttttgagacggagtcttgctctgtcacccaggctggagtgcagtggtgcaatctcagctcactgcaagctccgcctcccaggttcacgccattctcctgcctcagcctcccgaatagctgcgactacaggtgcccgccaccacaccggctaattttttgtatttttagtagagacagggtttcaccgtgttagccaggatggtctcgatctcctgacctcgtgatcagcctgcctcggcctcccaaagtgctgggattaaaggcatgagccactgtgcccggcctaatttttgtatttctgtagagacaggatttcaccatgttggctaggctggtctcaaactcttgacctcaggtgatctgccctcctcgccctcccaaagtgttgggattacaggtgtgagccacagcacccagaccatttttaagtgcacagttcagtggtattacatacattcacagtgttgtataatcgtcaccaccatccatcttcagaactttatgcatcttgcaaaactaaaacctgcccccattaaacagcagcccccctcatcccctgcccccaacccctggcaacccctattctactgtccgtgcctatgaacctcactactctatgcacctcacatacgtggaaccacatggtatctgccctttcgtcgctggcgtctcttagcataacgtcctcaaggttcatcggtgttggggcacgtgtcgggattttatggtgtgtgaatgacgtctcagtttaaaatgttctagagttacccagtggtgatggatacacaactctgaatatgccaacaacttctgactggtacactttgagtgggtgattgtatggtctttgaattgtgtcaataaagctgtcatttaaaataaaataccaatccgtgctggcacagagaaggactgggagactccgggcagtgcgcaggcccctgtgtctaggagagtgaggggcctgctgacctcgtcccgggcaggcgtcccaagagtctaagttccaggccttaggtctccttacgtgggtcttgtgcgcatggctcaggtggagtggcgacctgaacagtcggcactgctacgtgaggacgagtgtggccccagatggaaggcctgagcggaggcagcagggatgagggtggcatgggtgttgttatgcactgatttatgttctcccttccaaaactccacaccaaagccctcacccccaggacctccgaatgtgtatttggaggtagggtccttaaggaggtagttaagttaaaataaattcatgagggggtaggtcctgatcccatatgactggtgtccttctaagaagaaattgggacacagacatgtacagagggacaactccgggaggactcagggagaaggtgccacccgcaaggcaaggagagaggcctcaatcggaaccagccctgcccacaccttgatcttggactcccagcctccgagacaagacaataaatgcctgtggttaagccaccggtctgcagtgcctcaggacacagacacaggtggtgatgaagccaggcgagaacattttgaatgcatctagggatagaatcggcaggacttgctgatggatccaatgcaggacaagtaggtgaccctgaggattttatttgagcaaatggtgcagtcaccagtcagacgggggacccccgggcaagcacagtgcagtttctttgcaggtgcatccatgaagggtgtgatgcctaccagacattcaggagctgcagccaggtgggcagcccacaggggagtctgggcttctgggaggaagatgcagagccgtcctggacagggcagcagcagcaccagccttcactggagccggggcctgcagcctccattggtggcacacccaggtgaggtcttcacactgcctacactaaagcaaatgaacaacaaaaatcatgagagacccttggatcagttttgcacgggagaagtcatttctttcttttctttttttttttttcaagatggggtctcactctgacacccaggctggagtgccgtggcgcgatctcagctcactgcaacttctgcctcccaggctcaagtgatgctcccacctcagcctcctgaagctggaaccacaggcatgcgccaccacacctagctgtttgtttgtttgttttggtagagacggggtttcgccgtgttgcccaggctggtctcaaactcctgagcacaagcgatctgggattacgagtcactgcgcagggtggggagaagtcatttctatgcgcctcggggaagcagtgtggacaaggcccgcagggccctgctcttgggctgattcccttgagggagagcctaatgtgtaagtgaaaaatgaaatgtgcaggagagccactggtcaagcagcagtgctggggcagcaggccctgtcggggatgccagcaggctcagagcacagccaggaggagccggcctccagacaaaagcacatttgctaaaataactttgagaaattttttaatgtttttcaaatttttaccgaaatttagaaaaatttcctctaaactttgcttaaaccgtgctaaaaagtggggacaagcctgaacaaaggcctgacaccagcaaaggtcagcgagcagtgcagaagaggcgggaaatattgccaggaggtggccaggcaaggagaggcgagggaggtccccagagcgtctccccacccccgattggacccaaggcactgggtagtttgccgagggcagtgcagccaccttgggccagggtcccagccgcttgccctctgtcaggagttgctttcttttttttttttttttttttttgagacggagtctcgctctgtcacccaggctgtagtgcagtggctccatctcggctcactgcaagctccgcctcccgggttcacgcgattctcctgcctcagcctcccgagtagctgggactacagttgcccgccaccacgcccggctgattttttgtatttttagtagagacggggtttcaccgtgttggccaggatggtctccatcgcctgacctcgtgatccacccgcctcggcctcccaaagtgctgggattacaggcgtgagccaccgcgcccggccaggagttgctttcttaggtatctccttggatcatgagtttcagcgaggaggggtcgtctgcacaggaaacacgccccggccgttggagactcgctgctgcccccacgaggcactgctcctttggagtgagctggccaagcacaacacagagcctgctccccaaactgggcgggacagcgccaggcctacagtcaccacggaatgtgctctctcactcagcgcctctcctggagcctgagatggctccattcagcactgcaatcctcccagcgaaccccagccaacccaaacagccttgtttgtgcggggctctgtttcccagtcaggatacagggcagcagggcgggaaggagcctcagcagctccccagcagcacacaccaccggcctggcttccctgctctgttcgggaatctcctcccccacaccccccgcagcccccagccccccaggaacacttccccagtgggctctagcctcacctacacagcccccaccagacccctgcgcccgtgtctcagaggctgtcacagagacaaccgatggccctgcccatcatccagctggtcacgccgatgcctcccccacctcccgcaccacatctggtgccacacagctgtgaccaggtgtgactgtacacagggatggcccccatcccctctccactgtcagtgccctggccccaggcctctgctgtgcctttggggagtcctcccactgcccactctgctgtccagagacagacaaatatacattatccagtctgtgacagagagataaaagattcactaaaattgtttaaaaggatgagattctgcagattgtatttttcaaagatggccacaacacttccttctatcccacatgctcttccagaaccctgatactatctgtgaatctcagtgatctcattcccttataaaccatagaatgccacagaactgatgctacagagctcctgaggctggggcgcaagagataatgcagcatctgccttgggtgccagagcactatgcacagagacttggggccaccatgctttcaacgttgccaggctagcccacctgcacagaggtagttgccaggctagcccacctgcacagaggtggttgccaggctagcccacctgcacagaggtggttgccaggctagcccacctgcacagaggtggttgccaggctagcccacctgcacagaggtggttgccaggctagtccacctgcacagaggtggttgccaagctagtccacctgcagagatagttgccaggctagtctacctgcagagatgatataagacttcatggaaagaaacatgtccagccagttgctccagctccagccactgtctgcctggaatggcatgaactacccagctaagatatcctgaattcctgacccccagaaaccatgatagatagtaagactaaattgctattttaagtcactaagttttgagttgttatgcagcaatagataatgttatgcagcatttcataacagaataaagtgcacagagagacccacaacatgtagccaattgattttcatcaaagatgaaattggcaattcaatggggaaagtcaaatattttaaacaaatagcactcaaactattggataaattgggaggatgaactttgacttctacctaacaccgtacgcaaaaactaattcaaggtggggcgcagtggctcaagcctgtaatcccagcactttggaaggccaaggcaggtggatcacttgaggccaggagttcgagaccggcctggccaacagggtgaaaccccgtctctactaaaatacaaaaaattagccgggggtggtggcacatgcctgtgatcccagctactcaggaggctgaggcatgagaatcacttgaacctggaaggcagaggtggcagtgagcagagatcgcaccactgcactccagcctgggtgacaaagtgagatcctatctcaaaaaaacaaaacaaaacaaaaactaattcaagataaaattatagtcctaaacataacaataaaactgcaaagcttctagaagaaacagaggagaatatatgtataagcttggagtcagtaggcaaagatttcttggaaaggacacaaaaagcatgaaatataaaatttttaaattgatacattggattatcaaaattataaacatctgtttctcaaaagataacattaaaatgaaaataattctggtgtggtgactcactcctgtaatcacagcattttgggaagccaaggtgggcagattgcttgagcccaggagtttgagagcagcctgggcaacatagcaagaccctgtctctacaaaaaatttaaaaattagctgagcatggtggtggacacttgtggtcctagctactggggaggctgaggtgggaggattgcctgagcctgggagtttgaggctacagtgagtgatgattgagccactgcactccagcctgggtgaccgagtaagatcctgtctcaaaaaagaaaaaaaaaaaaagaaagaaaagaaaagaaaaacaacgaccaaaagccattgtctcaagaaaatatttgcaaggggcatatctgacactgaactggtactcatattttttattattgatttgcagaagttctttatatattcaaagttataaaataggcagaattaatctgtgattatagaacacaggtcagtagtggcctggactggggtgggggtgggagggtgggaattgactgggaagggacacggaacactttccaagggtaatgaaaataggatcttgattggggttttggttacatgggtttatatatttgtcaaaattcattgaattgagaacttaagatgtgtgtatttctctgcatgtaaatttcacctcaataaaataatttaaaataaacaaaaagggaaatgggtatccaatctgcagcaagtaggttaaaataacaacgatagctatttcagttcctttgcctttccatataaattttagaatagtcttatgactatttgaatatccactaaaaaacctggcttatatttttatattttgatgtataggaatgtatttgggcataactgacatctttacaatactgagtcttctaatccatgaatatggtgtatctctttctttatttagatattctttggtttatttcatccacattttgttgctttcagcataaaaatcctacccatgttttgttagatttaacacctgagcactttactttttgagagattataaatgatactgcttttttctttttttctttttttctttttttttgagatggagtctctatctgtcacccaggctggagtgcagtggtgtgatgtcggctcactgcaagctccatctcctgggttcataccattctcctgcctcagcctcccaagtatctgggactacaggtgcccaccaccatgcctggctaattttttaaatatttttagtagagacggtgtttcaccatgttagccaggatggtcttgatctcctgacctcgtgatccgcccaccttggcctcccaaagtgctgggattacaggcatgagccactgcacccagcccaatgatactacatttttaaagaaatacaattgatttttaaaatttttttatttttattttttgtagagaaaagatctcgttatgttgaccaagctggtctcaatgtcccggcctcaaatgaccctcctgcctgagcctcccaaaggtctgggattacaggcatgaggcatcgagccacagttggtttttgtatgtcaatcttatattcttcaacttgctcaagtgagaagaaacaatctgcctgatctcaaggcctattccataattatggtatttaaaactatatgggattagcagaagggtggacacatagatcagtgaaacagtagagaactcagaaatagatccatataaacatgccctagtgatgttttaaaaataaattttattgtgtatatttgaggtttacaacatgataggtttttttggtttggggtttttggggtttttttttgaaacagggtctcactctgttgtccaggctggagtgcagtggtgcaatcacagctcactgtagcctcgaccttccaggctcaagtgatcctctccctcagcctcccagacagttggggctacaggtgtgcaccaccacgcccagctaatttttcatatatatatatatatatatatatattttttttttttttttttttttttgtagagatgggatttcaccatgtcacccaggctggtcttgaacttctgggctcaagcaattctcccacctcagcctcctaaagtgctgggagaacgggcgtgtccctagtgatttttgacagaagttcaaaagcaactcaatgaagaaaggatacaacaaatggtgctgaagcaaccggacatatatagatgtgttaggccattcttgtattgctataaaggaatatctgagactgggcaatatataaaggaatgaggtttaattggctcacagttctgcaggcttcacagaaagcatggtggtggcatctgttcagcttcttgggaggcctcaggaagctttcaaccatggctgacggtgaagggggtcaggcatttcacgtggcagagcaggagcaagagctaggggaggtgccaacacttctaaatgagtagatctcatgggaactcactcgcaatcacaagaacaccaccaaggggatggtggtaaaccaatcatgagaaatccacccccatgatccaaccatcacctcaaacactggggattacatttcaacatgagattttgtggggacacagagccaaaccatatcaataggcaaacaaaaacaaaaccagaaacctcaatctcacatcttatttaaaaatcgactcaaaatagaatgacaggccgggcacagtggctcatgcctgtaatcccagcactttggaaggccgaggtgggccaatcacctgaggtcaggagttcgagaccagcctgggcaacatggcgaaaccccgtctctactaaaaatacaaaaagtagctgagagtggtggtgggtgcctggctgaggcaggagaatctctggaacccaggaggcagaagttgcagtgagccgaggtcgtgccaccgcactccaggctgggtgacagagcaagactcaagaaagaaagaaagaaagagagagagagaggaaggaaggaaggaaggaaagaaggaaggaaggaaggaaaaagaaggaaagaaggaaggaaggagaaaagaaaagaaaagaaaagagatgccatctcaaaaaaaaaaaaggaataataaactgaagtttagaatgtaaaactataaaactttcagggaaaaaaatacaggagaataatctctaggatctagagctagggaatgagttattagacttgactcgaaaagcaggagccataaaaagaaaaattgataaactggactccattaaaattaaaacttttgctctgtgaaaatttctctgttaaaagtggttctgttacaagaatgaaaaatcaagctacagactaggagaaaacagttgcaaaagatatatccaagaaagggctagtactagaatatataaagaactcaggctgggcgcagtggcgcatgcctgtaatcccaccaatttgggaggccaaggcaggcagattacttgaggccaggagttcgagaccagcatggccaacatggcaaaacccatccctactaaaaatacaaaagaaaaaaaaaattagccaggcgtggtggcacccatctgtagttccagctactcaggtggctgaagcacaagaatcacttgaacccaagaggtggaagttgcagtgagtcgagatcatgccactgcactccagcctgggcgtcagagcaagactccgtctcaacaaaaacaacaacaaaaaaaccctctcaaactcaacaataataaaaatccaattagaacatggacatgagacatgaatagacatttcaccaaagaggatacacaggtaacaaataagcacatgaaaaatacatcattaatcattaaggaaatgcaaattaaaaccacagtgatatcactatacatctattagagtggcaaaaaaagcctggacacagtggctcatgcctgtaatcccaacaattcgggaggccgaggcagaaggatcgcttgagtcgaggaagtggagctttggtgagctgcgatttcaccactgcactctagcctgggtgacagagtgagaccctgtctaaaatatatatataatttttttaattaaaaaaaaatggccaaaaaaggtgatactgttaaatgctggtaagaatttggggaaactagagcactcatatactgctagtgggaatgtaaaatggtacagcttctctaaaaagcagtttggcagtttcctttttttttgagtcagagtctcgctctgtcacccaggctggagtacaatggcgccatctcggctcactgcaacctctgcctcccgggttcaagcaattctcctgcctcagcctcccaagtagctgggactacagatgcatgccagcacacctggctaatttttgtatttttagtacagaactacttggcaataaaagagaaagctatcaacacacagtaacctggattaatctccagagaattatgccaagtgaaaaaagccaattctaaaacttcccacactgcatgattccatcaacgtgacattcaaaaaatgccaaaatcatggaagcggtgattgagagactcaggaggggaggagagtggaaaccgggcatggctgtcaaagggtgatgggaatgttctgtgcctcaccttgatcaacgacaacatctagcttgtagtattatgatattataatacagtgtttcaagatggcatcattggggaaaactgggtgaagggcacctggactctctttgcattgtttcttatgctgtatctcaaaataacaggtttcattttaaaaatatacaaacccttgtgactaatttaatcgacgtatcctactagagatacttttctggggagccgtggggagcctaccacacccctccttgtggctccattagcctcttctcacttagaccagggatgatggtgaggtggtgccaaggaacgtggtgggtgcagctcttactccaaagtcagcgaggagcaaggaggaggtgtttgcgctgtcacttcagcagtgaccagattgcagacagggaggcaggtaagactaggacttgaattgtgtgtggtcgagacgaggagttgaagagttaaatcctcatcctctggaatggtaagtcaacacacagtgctaaaactatttgccatggaaatgtctcccaccgtgaaagtgttcatacgcttctgttttgttttgttttgttttgagacagggtctctctttgccacccagactggagttcagcatgatcctggttcactgcagcccctatctcctcctgggctaagcagtcccctgacctcagcctcccaagcagctgggattacaggcacacaccacagtgctgggctaattttttgtattttttatagagacagggtatcgccatgttgcctaggctgtctcaaactcctgagctcaagtgatctgcctgcctcggcctcccgaagtgctgggattacaggcgtgagccaccagcgcccggcttccctctgtattttaatagtcttcagcatgatgttggccctgtaataaatatctagacaccaatgtctctctatataaagatatggatagactgataatatcatagataaaacgatattttatgattaattattattattattattttttgagacagagtcttgctctgtcccccaggctggagtgcaatggcgcaatctcggctcactgcaacctccacctcctgggttcaagtgattctcctgcctcagcctccccagtggctgggattacaggtgtgcgccacaacgcctagctaatttttgtatttttagtagagatggggtttcaccatgatggccaggctgatctcaaactcctgacctcaagtgatccacctgcctcggcctccaaaagtgttgggattataggtgtgagccactgcgcccgactgattaatttttaaaaatcacagtgggtagctagtatttgtggagccccttctctgaggccccgtggtcccatctggacctcgctgcactggggagccaccttccactgttgtcccactgtacggatgaggagcccaagctctggtccaggtgtgagcaagtgacaaggagccaaggagcccttcccttcacaggtgcttccctgcaggtggggtggccaggtgtcctcagaccgggtggctctccctcagggaccggggtggggcaggaaggaggaaggagttgttgcgcattcggcacaacccatgcctgctctgctgccagccgcgtggaagcttgattgccatacagcacagactgctgcctttctatgttgctgactgtttttaaagaggggttttgggaggggtggtatgaaattgattgtttctctctttcctcattactgttcgcacctattttgggtgttttgtttttccctgtgcttcctgtcctctgtgcactagggaagcctctcaaatggcaacagaaagtggttggtttctttgaagagcatttgaactgagtgaattttcaaaaagcgtggcattgacagaacaatgaaagtcccaggataaagtccaggccagttgccatgacagacggcatctgttgttgacagaaacatggagccaggctgaaactccggcggcaggagggctgcgcacctgggcagggcagtgccgagcacagctcccagtttgggtagccagtgggactgggtctggtaccagccttgatttcggactggagcagagtcacccagttgtgcctctgttttgttttctgtggagcagtggggggcccaccacacccctcctcgtggcttcattagcctcttcttgcctgaaccagggataatggtgaggtgatgccaaggaacatggtggatgcagctctgcctccagagtcagccagcagcaagaacgagccatgcaccatcactgctgcagtgaccggactgcaccccgcagagctctgatcgcctctctgggggctgccgtaagaaaacacctgggtggtctcagaccccagcactcgggtggctcctctgaaagagatgttgttcccgactcccagcctgtgggtagagaaggtgccaaccccacgagagtctccaggccctgggcctgcttggacctaatctgcttacagttcatgcaggttctctatccaggccttgccctcctcccagctgtttcctagtctccttcatcctgcaggagctgcttttggtctcactgtactttgttgagtaggaggcatagcagccttgagagctagaagggtccccagccatcacctgggccaagtcccgccgtggacaggtgagtgtctactgttttgtaggggcagagactcagcccagggtcccacgggctgctagcactggcgtgaggcagaccattcacctttgccgctgcacgggtcatatcctcccctctcagccaacgtgctggcccagcctggactggcccagcccctcttccctgcttctggggtcctgttcaccccacgagccctctctccagctcttcttggataaagccccatgcccaacatggtcccaggcaccggcttttggggcagtcctgggatcgccagcagatggagctcaagggggtcatgcagaccccacccaggcctggctcccaggggctcccaggagggaacttcctacccattgaaatgcaaacgctggaattccaagaagcacttcagatacatacaagtcctgattgtgtttgattcctcctctggatggaaggcttccctctctgaagtcagacgacaaagcagaggcctgggactggtggtataacccagagaccctgcctgcctggcactggtggtacagcctgggaccctgcctgcctggcaccggtggtgtagccagggaccctgcctgcttggcactggcagtgtaacccagggaccctgtctgcctggcactggtggtgtagccggggaccctgcctgtgtaccctctgtccaagtcttggggtgcccctgtattgtggtttgaatgtttgtctccacaaattcatatggtgaaaccctaccctccaggtgatcgtactagaaggtggggcctttgggaggtgattaggtcacgagggtggagccgcatgaaaaggattggtgcccttataaaagaagactggaggccgggcgcagtggctcatgcctgtaatcccaacactttcggaggctgaggtgggtggatcatttgaggtcaggagttcgagaccagcctggccaacatggtgaaaccccatctctactaaaaatacaaaaattagctgggcatggtggcaggcacctgtagtcccagctactcgggaggctgaggcaggagaatcacttgaacctgggaggcagaggttacagtgagctgagatcgtgccactgcactccagcctgggagacaaagcaagactctgtcttaatcaatcaatcaatcaatcaataaaagaagaagcctggggtcagacacagtggctcaagcctataatcccagcactttgggaggcccaggtgggaggatcacttgagcccaggagttcaagaccagcatgggctacaaagagagatctcgtctctacaaaaaatattttaaaaattagccagatgtggtggtgtgtgtctgtagtcccagctactccggaagttgagatgggaagattccttgagccagggagattgaggctgtagtgagctgtgattgggccactgcactccagcctgggcaacaaagtgagactctgccactacaaaaataaaaataaataataacaataataataaaagagggtccgagagatacccttcaccccttccaccatgtgaaattatagagaaaatatgatcatctatgaagtgggctccactctctccagacgccaaatctgctggtgcctcgatcttggacttccagcctccagagccgtgagaaataaatgtttattgcttaagccctgcagtctaaggagttgtgtcatagcagcccaaacagactatgacaccctgtattcgtttgctgaggttgctgcaacaaggtcccaccaactgggttgcttaaatgaggcggtaatgatggagggcgttcagcctgcactcagaaaggtctttgcagatggctggaggccctggagcctggaaggaggtggatctcaggaatttcacccacacacacacacatatctctggccaaatcaagttctttgcccatttttgaatcagactgtcttgttgatgatgatagtaggctctctttgtgattctcaaaaataacctcgaggatcagggcagccaagacagtcccctgaggcacaagtggggcatgggcccctgccccatgctgcaagatgactgggccctggcatgggacaggggcttctgaggatgcaggggtctgtagttggacccttggtttgaccagtgtctgtcacagtgtctgtctgggagtcacgggcccagaccctgggccagaggtcgggcaaggctttgcaggctgttttggtagcaaggcccaaacctggccaattgcatgctggccctgcaccagaagaaggagacctgcccaacaaggccctcacccaggccgagcccctgtgcatcagccctgcctccctcaccccacctgccgtggccagcacctgcccagggcccctctgctgggctccaggtactcccccgaactctaagccagcactcgaggcccagccccgctttcctggctatgcaggcttgtggcatgttgatcccccaacgtgaagccccaaggaaagagggtctctgccaccactccgggtgtatggggtcttctgatctgtgccgctgtgagatttgcggctggcagctgcagtgcagaccagaggtacgagtcctgccctcaccagtgccctccgcctgcaccccttgctggttgggaagtcctagagggaggactgggtggcacgctggcactgtcctgccaagagggccacacgcagctgctcaccaggcgagagggggcaggactcactcaagacgggcctgcagctgaatggctgtgaagatccctggctgcagaacgagcccttcggcaagagccccggggaggggacagagtaactcctttgccctgcaaggccccgcttgggtctccccaggttcagctcccaggtgcacctgatcatgcttccttctttggctgaaacctgctcggccacctctgaggggatgctggtcaaagcatgcagggttgagggctgagcctcgtacctcctgcctgcttttccggtgaggacaaggggcccctcctttcctgcaaaagcagcccctgtcttaggggctctgtctcctgctgctcccccatctctaggggaccctaaaagcctccaccactttaaaggcagcctttggaacaaggaggggcaggaatccacttcagtccaggacgtgacagccggctggccactggccacggaggtccagcgacatgctttccccagtcaagtggaaggactttggcggcatcctggtacagggtgtgtctgtctccaccaacggggaatcccctgctcagggctgatcatggctccagcctacaatgggtgcaacacatgcttgatgggaaatggggtccaacctggggcaaatgaggagcagggcagagctgccaccacgccctgcaagtgggagcaggagccctcacgcaggctggccccgctctgccaatggccctggccatggcacccggggatggcagctcctcaccctcctgacccacaccatccgcccccgcagcaatgtgtgctgtgcattctggggcaggcagagctctggctgtcctccatgggagaggcggcctctgtggcgttcagtccggggggctggagaggacacaatggcagggaatgagctgagactggggtcctcatcctcacccaggtatggccatcacctgaggcctcgaaaccaggtgatgggccgccaagttgagggctctggcaaccaccttccccgtgggagcctgggtgtgcaacaggcagtgcatttgcacgcagcaccagggtccagggaacagaggtcctgaagacgggacagtagggtcctgtttattccagagtgattttcagatctctcttgcctgactgggaggtagatgcagtggggagctggagccagtccctggagcccagcgctgagctctttgtgatggaggggtggggtgagccgcaggatctaggtcaccgtgctctggccctgctctctgcctttcgcaagcgcttgctcccgtgggatgtttgtcatgcttccatgcatgacacaggagaatatcaacattggtgccatttcacatctcttcattcatctgctattcttccaccttcagcttctcataaaatcacagaactgcagtgaggacctctgcctgccgggacagcctggggatggtcccgtgcagccccctcaggcagcatccctgtggagggttcccctccgccccctaccgtggggagctcttcccagctgagtcacactgcacgcctggtccctaccctgggctgctctctgtgttatcttgcaggcgccgtcccagatccttcaggggactctgaaggcccatcagatgtggctgcagacccacctccctcagaccctcagctctggatccaggctggctccctgccgtggagcacaggcgccctttgtagcactcactccagctgcccagggaatcggggacttggtgtggactgagactcagcccccttgaagccctattctgtccaccgctgcaagacataggcggctttaagcaggaccaggccgcaccctccaggcagagacagctgctgtgggttctgtgctcttctaatgggcatgtcttcccatcggtgatgaggactgatttgtgcagtgacccccttacatttttctgaaaaggagatcaaggaaaacattcttcagtagaatcctcactgtgcacacacttccccttgtgctcggtgacagccactgcctttgggagcagggaggacgccccagaacctcctggtctccgcacacccccctgagctgggctgagcacacaagcacccctctgcagacagtagaggttttgggattcagaatatgcagtctgaagctccccagagcctggctctttagtcaggccctccttgcccgccctgtgaatccacgcctaggagcctgtgcccccacccagcaggagctgatgctgctgagcttcccaggtgccagacaggggctgagtgtgggggccagggagccagtcgggagtctgctgcctggcaggccatgtcctgcagaagagaggccagcatagggcacggtgggcctggaggggctggagacagtgctgctgggtcggcagagctagagaagggcagcccaggcagggggcacactagtgccaaggtgcaggggcatgaagctgcaggtcacacggcctccctcggagcccccaggtactgggggtgggttcaaatctcacagggttggcgggcgagggcttcaggaacagcagggacaggagcatgagagcagtagaaaaatgcaggggtcaggaggatcatctgggacccaccaggttgctggtgaattcaggggatagaagggatgtgagctcaggcctcgagcagctgcctgattgggacagcccctggctgggccgcgaccaggtcacagcactttgcaggagtcaggcctgggctccacggtcgtgggttctagtctcggctgtttagtctcaagcagatctccaccgcgccctgacctccacttcctgcgtctactcagggtgaaaaaacaccccattcccagcacaggtcagggttgcccgagttgatcatgcaggtaggcctgtggggctctcaggtgcctgacaccctgcatgcatcttggcctcttccctcatcctcagcctcagatggactgagccatctggaacctgtcagtggtggcctcagccctaactgcagatgacaggcttgggagtgtggcgacatgtgtcacctggagcaaactgctccccctctgaagcctgtcacccacaagacctgctcccaagggccaatggcaggtgccttattctttcgtcgccatcaccgttgccacctccccaccagctccatccttctccgggtcccagccctggggcgctcactcccctgtgtgctgagggaggcccagcatggttcaaatgcagcctctggagaatttcttcactaagaggctttttctgaaaagagtcaagctatttgtagcccaagttggttgaacagatttttcttggtgtagcttatttttttattcattaacttcttttccttatgaattaaaaaatagcatttttttttccacaaaggagtgctttatttacttctttttgtaccacagccagcgcttcctctgcctgctggggaaagtggatgcacacacccactttggcaggcagttttctttcaagccatggcatcttggagaggtaagtgtgtgtgttcagaccactgccctgtggctccagcccccctgatatcagccacagccccaaggcttgggtgttgtttgtttgttttttcattttttttgagacaaggtctcactctgttgcccaggctggagtgcagtggcaccatcacggctcactgcatgcagcctcaaactcccaggctcaagtgagcctctggcctcagcctcctgagtagctgagactacagactcatgccaccacagccagttttttttttttaatttttaatttttatagaaacggggtctcacattcttgcccagactggtctcaaactcttggcctcaagtcatcctcccaccttggccaccgaaagtgctacaatgataggcgtgagccaccaggcctgcctggttggctttttggtgaacaggagcataataagggtttcactgggctgtcagcctccattgtggtggccagtatctcaaagcctcacctggcagaactggagacgcgtctgctgaccgatgccctcatgacccattttcctgacttcagaaatgtcccatgcagacactatgccatccagcaggcctcccagctagacagggtgcagcctcgatgtgtctgtggagggactcgggctgtccctgcactcacagtcatggtgaccaaagtcccagagtaagggagcagatgccgcttcccccttccagcccaggcattttacatgaggcgctgacccaggaccacccttgacttcactcttccaaggagtggctcccagtcctatatattccatcagcctccaggctggctgtcccttaaacactggtctccaatctaactgcatttctgtaagtaatcttttgggacagacttttttaaaaaagatcatgtttatgccgtattcctcatctttcttgtcttctatctccagatttgttttaaaacctattactcctgtatacatgtgcctcccaccctttgagctatgcccttgacctgctatgcacttgtctcaaggccaagttcaaaccccctaacccaaggctgtccagagctgccctgccacctgagccatggggaggggcgctgagctggtgcctttcacaggctgcctgcctccccctgggcagggctcctgtctctcctcctttgtctccacaagcacaggcttgcatgggtcagcacgtggtgaacagccaaccatcattttccaattctttccaaaaagtcctgtctatgctcagaagtcctgcctggccctttgagtgcccctacccccacacacacattcttttttttttttttttttttttttttttgagacggagtctggctctttggctcaggctggagtggagtgcagtggtgcgatctcggctcactgcaacctccgccttctgagttcaagtgattctcctgcctcagtctcctgaatagctgggactacaggcatgtgccaccatgcctagctaattttttgtatttttaatagacggggtttcaccgtgttagccaggatggtcttgatctcctgacctcaacacacatttctttatcgaaattccaaattctccaaagctcagaaacataaaggtttttcaaaactcagtggcaaagctggacctgaacgatgcgccatcacttactgtctttatttcttccagttcacctgaatacatatgttttgccccgaaaatataaatgggtctgattatgaggagcagccccaggttccaaagaggtgccacataatgtatgatgtatacaaaaaagcctgagttccaaacacatcttggatgagaggttgggactgtgggggatccctacactggttagagttctagacccagagcagggttatggtcaacggcgctctggccacagaatgcagcagagcaaggactgtggaacaaagacgcggcttacatgaatttttcacttaccgtgctgggtgctggtgattcagagatggaaaggccctagcgacacccccctccacccagggagcccacgggccagcagagggaccaaggggcacaggacgggtggggagcagaggcggattccctggctgtggaggtactgtctatacggggtgcaggagacatctccatacaagggggccctcacctggggaggtggtgaccgcaagcctgacagccccaaagccttcagagatgccgcctggggacactttgggaaagtccaggcggaggacacctgggaatgtgatagtgacacaaatgaccggagagacttgctctcagtcactgagtctggctgactcactgaagattagggcctgaacttccccctctgtaaatggggtgcaggccctggccctgccttcacagtgcccctcggtcccctacaagccttctccgcagggtgggatcgggtctgcctggagcatccccacagcctatgggtcagcagagaagcaggcgcagagctggggtgagacggtcagggccggtcctgccagacacctcagatcactcctcttcacaaataatcccattttacagcccaggaagagagaggccggaccactgcccaaaagcctgtggcctacagcctgccaggtgcgtctgctcgcagagcaggtctgcgcagcaccgagcggtcagcaggggcaatgctgggcactggccagccgcgccaggaccatccctgctgacctcggcggggtggggcggagcgtgcagggtctggcccggaaagccagggcaggctttagagaagggccaccggacggatggtccgaggaccggcatggacccgggtcccagcgagggcggggggagcgtaaggctgggcctgggctgcggcaccggggaggtggcggggaggaggccggcaggaacagccgtgcagggcgggggcggcgcgggtctggtcgggtgaccccgggcgcggccagggctgtaggaggcgagggcgtcgccccgaggccgtggtctcgggtccatggtgggggacctgggtccccgcccccccgggccgccctgggtcgcgcgtgggcgcggcgggcgccgattggctgccgggcgcgcgggcggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccaggtgagcccagcgcctgcccgcgtgcccgcgcgcgcctttgtccccgccgcccgcgcgcctctcaccgtgtctctccgtctctcccccgcccgccggcccggacccgctcggaaccggacccggactcgaccccgaccccgaccccgcagaggacaagcaggtacgtgcgcagcgccgctcccccgccgggagacccggccggctgtcacccattgtgacactagcgccttgggcgcccaggcgcgaccccgcccccgccggccctcacccagccctgtcgcgatcaccgattgtcagccgggcagtgccgccgcgcctggggcttcagaggagaggagtgggggccctggtccccggacccgcacagcagggaccctgcgcccctccccaggatggggggatgggcagagtgtccccctcccacagggccagtgccagcatctcctgctgacctggcctgtaggccatgagctgggggtcctgggtgaggccatggtcgtggcaggccacgctgggggaggggagtcaggctccatcagccagcacagtccctgaacagccctacagcagagggcctgtggtcaccacccacctcccctgcaccttcatgcccctttccctccccatacacaaatttgagtgttcaggtctgcaacagggactcttccccagattgggaacccccagggtctggtctgagtcattctgggtgcccagatgggtcctgggaccctgtgggtacaaataggcttgtggcttctcaaaagggttggccccaccctccaggaaagcaagactggacaggaggctggtctaggcacctgggtgaaacccagccgagctcagggttaaacaatgctgtgaggcccctggggtggggcgggggctgacaaccaggtgggctgggggggctggggaaagcctgctggtgtcctctctggcttgagctcagccatctttggaggaaaaaagaagagcccaattctggcaccagggtggcactggcagcccccatcagggatggagtttctcaggagccatggatgctgagtggaactccagagtcctggcccagggtgcagcaggcagggcaggagggcgggcaggggggccaggagctgggggagtcactggctgaccagtgccattctcctggaagggacacaccccacccagaggtggatgaggctctctgggaggggccccttggggagccaggctgggagctgcctccccatcacagcaggtcagacaaagcctgagatgcagggacacatgcgtcaggctactgtttgagggaaatggaaggaactgaggctgggaaagccaggaggccaggcccctgaggcttctcctgtgcctgcaggtgtccccagcttgacccaagggcactctgagaccctgggctccagccactgctgttgggtgcagccaggttctcttgcccattactgcagggtggggaccccctcctgctgaggtgcccatcgtttgaggtcaaccgggagtccacctcaccccatcccaggcctcccaggcctccaagcccagaggaagaaggcactgtgtggccaaggaagggagccccggagcaggagccaggccaggtgtctgggtgaccagtgggtctgggggagctggaagcacatggcagcttccctgctaccaccgttgctgagcctcagcctgtccaagcattctttttgctctttgaaagggggctgtagaggcattgggggagttccgtcactacgctctgtgcccccacctcctcacaggcagcaccggtgatctcttggccctggctgctgctcccagagctgactcgggtgattctaagaatggaagtgccagagaggctcaggcattgggaggagatgggcgcagctgtgtcatatggctcaggaagccctgggagtatcttttgtcacttggggaccagagaaagggggtggcaggtacggccccttccttgaggctcccccagggaatccacaggccctgactgggccccagtgggtggcagggcaggtgggttgaacgctgagagtgagattcttgccctcctgacctgggcctccccagaggctgtgccttaccaatggggaaactgaggcaggcagtctgagagccacacactctgttagacacctcctagcctgaggcctaggcccagggctgtctgtcttcctggagatgccctgggcctgagatgccagcctgtctgggtgggtgctgggcttcgaggtgtggaccctcagttggaaactgggtgggactcagcctagaggcttcctgcaggtcagggccatggaaggctggggccagtgaggaggctttctggcagcaaggactgagggatgcactggtagagctggggggcctggagctgccccctttccctgggatgaaaggctctcctgttcccagctgtgggcctgcccctcctccccaggtgccagtggtccaggccccacaacaggaccagggcctggacaggaagtggaggaggtctctcagccaggagagcctaagggagggctggtggcgggtggggtggggtggggttggggcctccagcttctaatgttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggacactgacgacgctggaggtaacaatgaggacattggggacaatgagtacactgtgggggcggtgagaacgctgtggacactgaggacgctgtgggggcggtgagggcgctgtggacgcggtgaggacgctgtgggggcggtgaggacgctgtggggaccgtgaggacgctgtcggggcggtgaggacgctgtggacgcggtgaggacgctgtggggacggtgaggacgctgtggggaccgtgaggacgctgtcggggccgtgaggacgctgtggacgcggcgagggagctgtcagggcggtgaggacgctgtggacgcggtgaggacgctgtggacgcggcgagggagctgtcggggcggtgaggacgctgtggacgcggtgagggcgctgtggggacggtgaggacgctgtggacgctgtcggggcagtgaggacgctgcggacgttgaggacgctgtgggggcgatgaggacgctgtcggggcggtgaggacgctgtcggggcggtgaggacgctgtggacgcggtgaggacgctgtggggacggtgaggacgctgtggggaccgtgaggacgctgtcggggccgtgaggacgctgtcggggcggtgaggacgctgtcgggacggtgagggcgctgtggacgcggtgagggcgctgtgggggcggtgaggacgctgtggacgcgatgaggacgctgtggacgctgtgaggacgctgtgggggcggtgaggacgctgtggacgcggtgaggacgctgtggacgccgtgaggacgctgtggggacggtgaggacgctgtggacgcggtgaggacgctgtggacgcggcgagggagctgtcagggcggtgaggacgctgtggacgcggtgaggacgctgtggacgcggcgagggagctgtcggggcggtgaggacgctgtggacgcggtgaggacactgtggggacggtgaggacgctgtggacgcggtgaggacgctgtggacgccgtgaggacgctgtgggggcggtgaggacgctgtcggggcggtgaggacgctgtgggggcggtgagggcgctgtggacgcggcgagggcgctgtcggggcggtgaggacgctgtggacgccgtgaggacgctgtgggggcggtgaggacgctgtcggggcggtgaggacgctgtcggggcggtgagggcgctgtgggggcggtgaggacgctgtcggggcggtgagggcgctgcggacgttgaggacgctgtggacgcagtgaggacactgtggggacagtgaggacgctgtggacgccgtgaggacgctgtcggggtggtgaggacgctgtgggggcggtgaggacgctgtcggggctgtgagggcgctgtggacgcggtgagggcgctgtggacgcggtgaggacgctgtgggggcggtgaggacgctgcggacattaaggacgctgtggacgcggtgacgacactgtggggacggtgaggacgctgtggacgccgtgaggacgctgtcggggcggtgaggacgctgtcggggaggtgaggacgctgtgggggcggtgaggacgctgtgggggcggtgagggcgctgcggacgttgaggacgctgtggacgcggtgaggacactgtggggacagtgaggacgctgtggacgccgtgaggacactgtcggggtggtgaggacgctgtggacgcggtgaggacgctgtcggggctgtgaggacgctgtgggggcggtgaggacgctgtgggggcggtgaggacgctgtcggggcggtgaggacgctctcggggcggtgagggcgctgtggacccgatgagggcgctgtgggggcggtgaggacgctgtggacgcggtgagggcgctgtaggggcgatgaggaggctgtggacgccgtgaggacgctgtggacgcggtgaggacgctgtgggggcggtgaggacgctgtgggggcggtgaagatgctgtggacgcggtgagggcgctgtgggggcggtgaggacgctgcagatgttgacgctgtggatgctgtgggggtggcgagggctctttggacgcggtgaggacgctgtgggggcggtgaggacgctgcagatgttgacgctgtggatgctgtgggggtggcgagggctccgtggacgcggtgagtacgctgtggacagtgagggtgctgtggggacagtgaggatgctctggggggcagtgagggcgctgcgcggacagtgagggtgctgtgggggcagtgaggacacggtagacagtgaggacgctgtgggggcagtgaggatgctttgggggtggtgagaacactctaggcagtgaggacagtcccagcagtgtgtctcgtcctctgagcatgttcaggggctggttcttgtggacagtgccggccttgaggacaccaagagcatttcaagggttgggtttcctgatgcagggactgcggcgttggcagcattcagttcactaggggagcgttggggcaggtgaccagggctggttcaggtctgttgctccatccgggatccctggaccatccgaatgagaagatggcctctatgtgacagagtcacatgcggtgggggttcttggagggccccacagcgatgagtggacctcaggggttgcagggtctctggaatcattgtgttctggagtgaacttgcccccccacaggctccaccaacacccccaaaccctcttcctgccatccctccccatcccacagcagcggccctggccccagaccccttctgccagggctcagggctggcagcctgctcctgccagccaagagccgttcctgtccctgcccacagctgctgccttccccaggctcccaggctgcaccacacggggcctgcatgttccttctgactggcacaaggtactctccatgccactgctccttgctcatctcctgtgcctctggcgagtcccccaccgggccaccacttccctcaggaaggcctctccgactgcccagaccagcaaggggcttctcagagttctccagtctctggcctcccactgccctgcccggattctggagctgagcaaacaggtcagcacatggtgcccaacttaggaggtgactgacgccttcctcactatttgggctggcctggggtgccagggacagggttcctctgccaccgtccatgtggcccccacctgtctggccttatgaacaatggaaactattctccatgcatcccagagaggccccagatgaggagcctcaggtcctggctgcccggcccaggaaggccctcagcccccaatggccatcactgaccaccactgaccgggtcggggaggctgccactgacatggcctttgtcctggcctttgtgggacaagacagatggccctcctgtggggctgatgctatctcgaggctgccagtcagacgtgaggcaggaaccacccctgcctttgtgagcaggtgcagggcatccggcccattgtgggctgcagccgactgtggttgtccatccggccttatcaccacatcgaggacagtggccccctttatacaaatgaactgcccagcttgccctccccagcggtggcctggcacctccagaggtcctagtgtaggtcagaggtaaccatcgtcataacaccgtgcatgtgcaacactctaaactcagtccaagcagggcaggggagggggtgtgctccccactttctctaagaaaccagatcccagaagggggctctctgctgggccccagagcattttttgtgtgaactggaaacagggctgaggcaggcctcttgcatcccttctctgcctcactgaggtctttggggtgcaaatgtacagcccaggagaaagtggcccagggtcttaggtggcccccagccaagagaaggacgctcctctggtctgtgggaaaaggccccagcaggagatagggggagtgggcagcccactgcttgcaaggcttgaggtctcctgggccagtgtgtcgctcagggggtggcagggggggccctgaagggcaggagctgcagaggcagagggactcctgttgaggaaagctactggaatcactgtgtggttagacctaaggaagaacttcctgcctgctggtcggcggggcagccgaaccctatgattcctccacaatccctcctcttgccggctctccgtggtttagactggttcgtgccaaggtactgactgtggaaggcacagggcttccctcgctggctgaccttccttggctgcctgggagcccccagtccccatgcctgactctgagctgaccctccacacactgaccctggggcctcagcctccaaggggtgtggggaagtgagtagtcccagttcagtatacctgaatggccctgtggggacgggagaaaggcacaccctccctgcagatctgggcaccaccttgatcccagcattgtccttcatttcacagacaacacacctgccccaggaccccctccccactgatgagctgggcccctctgtgacctcagactcttccttctaggcaggaacaggttgggggtcccgtctccaagccctgcctggaccccgcacctccagtcccaggctagctgattcagggctccttgccctgcagcccaagggccctctcaccaccattgcccaccccacctccctgggctcctgggatctcagccttaggtcaaggcccagccctggtgcaccctcccccatgggccaggccctccatgcctttgcccgcgccagtccctccacggggcacgcccttcccgctgtggctactcctcaatcttagaggcccctcccaagcccattctcacagagcttcctaggcctgccctggcctgacacatagtgcaggacagtgtccaggcctgtgtccccaagacccatctggggttcaagccacatcttgggcctatacacagccagctagtgagtgagcgagcgagtgagtgaggccctgcaagatggtcatctgtcttgtcccgcaaaggccaagacaaacgccgtgtcagcggcagcctctccaacccagtctgtgatggccagtggtggtcagtgagggctgggccgcgaggctcacagctcaggccgcacccgccggtttcacagaccggccaggaagctcccagggcgagggcctagtcgtgtcctccccatgggcgagcaaccctaggcaggcaccagagggcgctcgcggtctgcagaaaacgctggctaaggggggagcgcggaaagaggtgggcactgtgggtgcagacagctggggtccgcggagaaacgaaggcctggagcgggggcgctgggttgtccaggctggcggcgagctgcaccgagtgggacgggcaggctgcccctagtgagggcggggagggtgtcgccgcgtggcggctgacagacggggcgggatgagcgtagcccccgcccctgccctggtgcactgacagcctgtcagccgggaagataagggacttcttccgctgggcgtggggtgggggtcaacccaggtgcgctgtccccctcccgctggtgtttgctcggtaaacacttattgggccccgggctgtgcacaccgccgcgggggaggggcgggcgacctgaaggcctggactccatggcctctgccagggatgccgggtccatgggccatcaatgatgcaggaaaagaggctctgtcacctctggccccgcctggagagagttgcctgtggggtccttcgtgggccccctccagcctggggtggccctagcctcagcttcagagctgggctgacccccgactagccgaggcattaatggggccccgtggaggaggtcctgggaaggtctggggagctgaagtcctggccacgtgggggggactgcaccccctgcccagacggagcaacaacattggggtgggtggcggggccctgggggcccatagctcagcgcagcgtctgcgcccaccccctgtgtttccgatggaagacaggctgaaggtgataaatcaccaggtcccacccccacccaccctgccaacgggtggggaaggggggctgcatgtgacagagatggggaccgagacagagatgggagccaggtctagaggagagaccagagacagtggcactgtggtggccccgttgacacgggccaggacccttgcttgggtgtctggcctccccgctctgggcgccccttccacaaagcccatctggaaaccagctgagagccaccgtacccccaccccggctgacccccaacagggaggtagaggagggagggagacctttgcagccataactccgtcccccgcctgcccgcccccaggaggaccataaatcagcaggggctctcaaagcactacctccacaggctgaagggagggcttcagggccactggtcttagggactaggcctgtccttggctgtgtctgtccctctttaaacagccctcaggctgaggcaggcatatcacttgaggccaggagttcaagaccagcctggccatcatggtgaaaccctgcctctactaaaaatacaaaaattagccgggcgtggtggtgttgggcacctgtaatcccagctactctggaggctgcagggggaggatggcttgagcccaggaggcagaggttgcagtgaccccagatcacgccactgcacgccaacctgggtgacagagctaaactctgtctcaaaaaaataaaataaaaataaacagccctgaggggaaccccagtggcccccacacccagcacagtcgaactgactgagcactgtctacactggatgtacacactcacatcctcactttctctctccagacaggaaacgtctgcagggagcaactctgtgtcctcatcaggagaccccctgttgctggcccctcaggaactagggatcagcatgtcctacccagtgaagccctcctgggggtcttctctgcccataggaaatgcctccttctatcctgtcttcctgtcaccaccaccccccagggtactgagggccagctggacaaaaggtggtgagagatgggccaggtggatcccccgcaggtgagcgcaccccacacacatacacacagggcaggtgcagagtcagtacccagtgggagaggcttgagagggcctgggggagtgctccctggagctgtggggtgtgctcagcagcctagttctagccgggccggcctcagcaacccctgtccagggtctagcctacagacattcccagggttcccgtggtgggcataagggcattgtacacaaggaaacacagatgtccaccgtgacatcaccccagcttgtctcaaagagccgtggggttggggatgagggctgcttcttgtctagaaagaccttcagagatgttggaattctgtgcctgagacaggcactgactgtcactgggctggcctgggcctggttacctggactgtcgccttcatcctcagagcaaacccttgagtctagcactagcgatgtctcaggggagggttcagagtgtgcagcagctggaagtgtgctcagctcagcctgtaggagggtctggcttttccagaatgtcccagggagaagagcgcaaggggagtagggtgctggggtgtgcaggggagcccatctcccgtcatccattcacgttcaatcattcataccagtgtgcagacctgtctggagcctgccggctgccagggtcaagggctgggggggtgcagatcccttggccccagacccccacctggcagaggcacttcactcctcttccatccctcctgagagggccagctccctcctccccgcactgggattccccctagtacgaagtcctctggggctcacctaggtgtatttaagcatgtctgacaaattgagggactccaggcctaacagactggaaatgggccgggaaggcgagggctcactcaaccacagggaccagtctgccctgcccttcccaggccgcccaggtgtgactctctccactctctttgtcccagccacgcaggaccttagggccagccctgcaaggtcactgcactcctggtggggtacaggaaccctcaaagatgggaggatctggaagggaagccattgaactttgcctgatggacccatgggatgtgggggcacagaccccagctgggcaccagcaggtccccatttggctggaccatgttgacagaattagggtgcccactcctgggaggaaagcctcagtctatggctggaggtccagtgagccaggggtgagggtcccagggcagcatcagcccacagagcagaccaaggcttctgccaactgcattgcaccatgtggcagctgtacctgccagtcaggggatcccaagctggggtggggcttcaaggaggtgcctacgggcagatccagggccgagctctgcccgggtgtctgcttcaaaatctattttgatgtgctttgtatttggggagttgcttttctctatgctttgtttatttaaagatgctattgaagagttccagccaaactttgtaaatgccgaggaacgggctgctgtctgagcagggctggggagggtaggagcccctgacagccgcctgtcccagcatgcccaccccgtgcccttattgcccactgaaggtgctcgcgcggcaccaactgcactggcttcctccaggagggtagcctgggggctagggccagagaggcaccagtacgcagagcagtacgtgaggccaaggacctggtcactctgagaccaagcaggttccaggcatctatgctgaggggagtgggagaccactgactttctttgtggcaaaagtggggatggacctgtttgtgtgagctcagggcctctcttggcactaaatgcctctcttggccaccctctgccctggggtccttggcatgggactctctggtatgggaatcccaggtctatggaatgttagtctatgagtccctggtctggggttctgagcctgaagagtcctgctctgggtgtctcaggtcagcaggtctctgacaggtgtctgctcagggtccatagtctaggggtcagtgatctggccttttctccccaggggtgccaggtgccgtgtgctgccatggatgtctctgggatatcagtcagccccttctctgttggccaaggagccactgctaacaggagttgtcccagagggtcacactcttgagtctcttgtggcaaggtcaacaggaggaccatctggagcacggagagcatccccagatcataggcagaagggtgtttcctgctaaggccagccagaagactccacagacctcccaagtcctggctagactcaatcctgctgttataagtctccctgggtcctccctgaatcctcccagagccctccctgaatcttcccaaaagctccctgaaccctccccaggttgtctcctggagtcctcccagtctttcctggatcctctccacatcctccctgagtgctcccagaatcttcctgcagtcctccccatgttctctcaggcgtgggctgctgtacctggattggccctagcaggtgactcgggctggagtttggttgacaccagtggagccacaagcctgctgtgcacaggtgtgatggcaggcctgtgagggttcggggctgcatggccttgctccctttgcactggtgtctggatgtgctcagaggccccctgggtccccaggcctctgggacaaggccggttgagtctcaaaaacaggtaggaccccaagcagagccaaggcatcaccagccccagcccttgttcccgtgtgccccatctcccgaagcactcccctgtgtcatgcggtaccagctctgcctctgactccccatgcagtggccctaaggccaccccttgtcagtgtcctcctgggcctcctggggcgggcaagaacctgctcacacaggtacatgcacagcaagcatcggagggtctccttccctgggagacatcaccgccccacagtgggtcaccctcaaggctaaccactcagcttccgggtggcaagcctgcagagtggccccaggcatgccgggccaccttctaagtgtgccagtcccaccctgtgtgtgtgtgtggatgtgccagagatgtgcagtcacacttccatctgtgtcccatgcccccatgagtgtgtcctcacacctcttgccccgcctccctgctgtgtgcccctcgtagcagcttggccctgcccgctgcaccatgtgtacacagaggcttattttctctgcctttcgggccaggggcgtgctcgtaaattgtgcagtcgacgacacatttatcccgcgggcggctggcggtgtgaatttatggctgcacccccttcctggctgaggcaggacaggggccgggatacctctcaggcaggaacctccagtccactccactgggctgttgtggggccatgggggcgggctgggccgggagggcttaggagtgctcccaaggtctggtcttgcacagaaaccctgcaacttcagggtgcttggggcaatgagaggcgaggccactctgcctgggtgagggctgggggcacagtggctgcccacgtgccagaggcatggaggcccagagcccagcctaatgtcccagcctccatgcccccttccagtcggcttctcatcttcccacctaagaaagaggggacaacttggatgccccagggacagcaggtgtgggggtggctcccctcaggtgctgagtcagccacccactgccactaggcccactgggagtactgagatctggggaggactgtcagaaagggtgggggcctcgagggcagctggggctgcacacagggaagaggagcggagatactgtcgaatcagagcagagagcccctcagagctcacctgccctcctctgccttgtaaagatggggaaactgaggcccagggagagcagaggtcccaggtcacatgggtaggataacagagcctcaagatcctggattcctgctccctagtatgcaataaagggggtcctaggcacacccctccccacggagccacctttgtcctgcaaagtctggaggtggggcctccggctgaagcctcaacagggagctgatggagcaaattggcaagctggtcccatcagggccacagctggggcctgggacctggctgcctcccctccgtccgtcggtctgtctgtgtgcagggtcgggtctccaggggaccctctgtcggctctcaagctccctcccatctcggccccagccccccctcaccgcccgctgtcaggatgagcgatggccgtgcccctccccggccctcggccccaggcccggttcccgctcattagccactgacactgtttgctttcccgccatggacgcccaccccgtcacaggccattt[450 bp omitted]cccctcaggcagccccagtacacagcctggggggtgggtcctgaggcagcaggcacccctccctcctgcaccacccccgcccccaatatggccacagctgggcggcatcagggcccgcaggccagtggcagccagtccttcacttaaaaatgtgtttgtgatttcggcagcgaggcagataacggtgacgaatggcccgcctgccccccagggccctcagcccatctggtttgactttggcctgtcggcagtgcccttgggcctcactcctgccctctggcagtgccctccgagtgaggcacccctcaacctttgcacactctggttcctttgctggaaatgcccctcctctccacccatctgtccccccatcatgggctcccctggctatgcccataggagccacccatgcaacactcggggtggcaggtcctgggcagtgctggggtttgcagggtgggggagggcacaggcccagcagggagggggcatgccttgcctgggccctgcatcccctctgtctaggagggaatagtgagtgcccacctaaggccagaggggccgaggctaaggtgacggagtgggccaggaccgagagaggtggcccggcggccagggcagggcctagccctgtgagacagcccatgtggtcattgtcaggaggaatttctgacagggctcgggaccctcctgaccatcgattatccaagcaggaggagtggcttccgggtccggctgtgggctcagctgggaggtcactgaggtcaagcccgagtgcccctcctcctccagtctccccttctactcccttggggctccccagttgggcagaggtgcctggaaggttgctcctgcccagtttgaatcctggccagctaccacagggagtggtcaggggtccactagggactggagctcatgcattccttagcacaacttcccaatcaacccctgcgtgcccaggtcacagacggagtcagacctggccctcagagaggagataaggagaggtggaggtgcttagagctcccctggcccatctcaggggttggggaggggcttgtgtagagggagggcattcgggcaggatagaggaggcagccctccctgggggtctggggtcgcctccaggagaggcactgctccattccccactgcaccctccaggcccactccctgccctgtggcgaggacagctgtagggggaggggaggggcagcgccgtgtcaggacccccaccccctcctccaaagcaggaaaatccctctccgttagtatcacattgttgagaattaactttgttgaaataaaaattggtcgtggtattaactcggcctcaaggattttctctgggatcctggaggccgcagaggggtcagacgcccattcccagggccagccgctggctcgggtttcggggactccagcgacctcagatccttgggacacggtgcctggttcctccgggttgagggagccaccccagtcctgccttctacagccccggacacgaaggaggacggcccagacagtgtgggtcttaggcatccatctgtgcccctcccccatgtctccgtgtcacttgcagccatggctgttgagccacaagatgcccctcccgctcctcaggggtcagccacggccttagtttccccacatgtaaaatgggagcttcaccccagcacagggtgtggggggccctgggcacagacaggcagccggatgctcagacaccccagaaacctggggcgggcacgggtagggacagacccacccaggtctctccagagggcaccaggtggccacacaggcactcctggcctcagcacagcctcgctggccacagaaagaagttggcacccccgactgtctgccagcagggcgtgggcacttgctcccaaggaagcaagcagagagcccacgcgtgctgccaagaagggacggcagccctcaaacgacacgattccacacagacagatccgcgcaaaactgctctgagaattgctggggtcccgcccccccgccatggtccctgctggacagggggcgtgagcactgccgagttcccacgcccccactctggagtgtgtattcctacagagggagtgcccacggacagaagcacaagggatggaggtggggcctcctcagggcctgcgggtggctggtcctgcgtcccggtagccaggggacaggcgagacctcccagccggtggtcccctggaagcctcctctgctcacatcccaggcagtgtgttttcgggggtggggtgcagcctgggaacgggctggttcgggggcctgggaacgaaggcaggggcccctggcgggggatgcaccagtgggcccagctgttgctgcctggctccaattcccactctgcaccaaggcctgtccctggggccaaggctggtggtctgcctgggagggagtgagggggtgtgggggccatatcttcctccagtcagtggtccctgggcagtagaggtaggagagaaccgccttcgagctgagtggcagagcccacaagcagggggtgctctcctgtctccccaagcccaactgcagcaggtcccaaagcctgctccgagcatggaatcaccctgaggccccatcccctcacccagcacccaagcccacctcctccctgggcctgtgttggcggaccagggcctccattatacaccatgagcctggcgccagcccaagccctccaggcctctgctgtggctgctcctcctgtcgagggagcctttgcaccagggccatcctaaaactcctacttaaccttcaagaccccatgcaagtgttcctgccccaggaccccaccccgaatactgggccctgcacccagctggtgtcattctctttacaagactcctgatgcccctcatctggcacaaggctggacaccagagtggggggtgcacatttccacctccaggagcaaaaaaggctgactcctcaaggaggcctccttcccaatgcctcagtttccccatctgaactgtccttggctgacagtatccatggtcctatgggagcaagtgtgaactctgggcaggaaccaaggccagtgttctaagcagggtggagggaccctgaagaggacaggccaactgggggctcctccaaagcaggagagtgggtgcccagccagccaccccacaaacatttggctggcttcagctgaggccaagggaaggcagagctgctggcagggtgggggccagagcgggattcttcttactcctaaaatccctcccgcctgcccagcgggccccgagggaagccccatgatgcgggaacctgatattttaagacttaaagcaaatgtttctggagcccgagctgggcctcggcgcccgcccgggccttgtgggggcagggccagcgaggaggagaggacccctcccctgaaccaatcctgcccctccctggactgcagtttctggtgacaggcaggggcaaggctggaaccccttgggcaccttaaggttccccgaaacctgagggtgggggccccgttgtcggctctccgctctgctggtccctctctcggctgccagcatcagatgaggctcactgagagccctgaacccctctagggctggctttgcctgacccagagcccagggatactccctttcttaccactagcagggtgggcgtgtacaggtgctgcttttgagccactggcaggagccacttggagctcagagctgacacctgaagcttcctatctgagaggacaggagatctgggactgactggcgatgtctgcctggggtgttgcaggattcctgcgcttggaaccgcagcagatgggatcttgctctgtcgcccaggctggagagcagtggcacaatcacagctcactgcagtcttgaaccactgggctcaatggatcctcccacctcagcctcctgagtaactgggaccacagacacacaccaccgtgcctggctaatttatttttttatattttgtaggtgggatcttgcgatgttacccaggttggtctcgaactcctgacctcaggtgatcctccctcctcagcctcccaaagtgctgggattataggcgtgagccatggcacctggccatgatagggtttttttctctatatatagaagggactccccatcgcttggaccatagggcagtctgacactcggctgaggctgagtgaagctggcctgggctcaggggcatgagttccaggctccaggccccacactggtgccacctccttctgggagcctccttgggggcctttgagagcaggagcatcacaagtggaggggtgactgggtcagggacagcagagcagggaggcaggggccgtgttgggcagtgaggaattaaggcctaataatgaaggctgtatctccaaaaaatgtttcggaggcagggccatccgggcccagctgggaatgtgggggtgtaggggagagacgttctccaggttctcccagaacaggccatcctaaggacccagccagcccagtatccagcccagccctccaagcacttggcaccaaggcccttccttgtctgctctcagctggtggggctgggccaagctcctacccactagctgacaagcctcctctggaccatgtccacattttacagatggggaaaccaagggccagggtgggaacagtgcttccagagagcctacagctggcctggctgtgtggacccttcctcaccacccctgaggtcctcctgcctcagtctggaggagggacggagctctggccagctgtttgggttcgtgcagacctgagcgtgagtccacctcggccatgtcccgcctccaggcactgtctgctcacctgaagctctggctgtctcatggggccttggagggtgtcaccacctgactttggtctgctcctcgctggtcctactgccctggtggactcctgtgcacccttgaaacccactggaatcctgcctaaatcgtgagcccaggaatgccccccacttcctagctccagcgcaagcactcagcaaccctcccctgacggggaattccttgtccattgcccccaggaaacccaccagcccccgcctcgggcagtcccaggcttggccccgccacttacctcactggacagtcttggactcacgctgtgaggacagacacatgacgtcacgccgccttagtttccccagctctgaaatggagatggtaaatgttgggtgggtgttaaggccgggtgtcctgagctgcccagaggaagggcagctggcaggagagctaggggtggtgcccaccctgggcctctgcagcaccacttcccactttaggggcccagatgccatccgcagatccttggtccagcctctcactaggcctggaagccaggctgccgctgtgggtagactcctgccaggctgtgggggctggggaaatgtgcccagcggtggctgaagccaggttgcctggggaaccagtgctccccagggggcctactgctgcctccaaggccccataacacccctgtccacagctccacccaagctcccattgctttccctcagcattttctttcatcctttgggcctcagtttccccacatgtgtctcgggaaatgacagatggcagatttgggggcgaggagaggagagggtatccaggcactttgttaggattgaggtggaaagaagaggtggtcagtggaacatggggcgccagggtggggaggaaggccgcaagatccccatctgtcccctccagaggcagagtgaggttagggcctcaccagaccaagtggaggagccaggatttgaatggggggcaggatgccgccatgtgggtggaggctccctgtgcctggggcctgagtgctggccaccacctgctgtctggcgtcctctccaatccacactggccctcaacccctgtcccaggctctggttccccacctgtcaggtgaggtccttttgagcccacggcactggggcggtctgggtggagtccctgccccctcccagcctcaggcagcatcccaggcacacacagcttgcttcccaggcctctttgaggaaggtcaacggccgagaactaaggctagggatcaccggaaacctgtcccatcctcgcccccagaccctctgaccgcagaatctcctgtggggctgtaccctgggtcccctcccaggcctgtgacccggccagaggctggaggcagacaggctcaaaaccaggccccctcctcaaagcctgtggaagcccatgagatgtcccccagcaccccagggtggagctcacccacctgtccacaagcaaaggcaggcgagggcaggaggtggcagtgaggccaggcccagggatgacctggcactaggcccagcccctacccacagcccccctctgcccatccccagccccctggcccagcttgggcacccaggctccaaaccagaaaaactagacggagagcaaacaagcccacggtgcagactcccatgtctagtggaccagtgtgggcagggccttggagctggggttctgccccggcagagccctgagagccagggcaggagtgataggcccatccaaccctgagttcaaggcctgtcctaccaggcaccccacgttggccctgtgcatccctcagtggagggggatttccacccaccagcctgcaaagtgagcactgccatgccagctgccccagatgccacaggctgcttctggggagtgggcttctcatcactaggggtgtgcaaatggtgccagcagccacggcaggctggccgggtaggactgattccccaaggttctgttcagagtccctggacccaagactccagagcctaaggctctggaattctgtcccctgagatggtgacatgtttcacagtgggcacagtggtgcgcacgtcataggggccggacaaacacctgcttattcaatcagcacacacctcagtggggtccaggggtggctgggtgcctcaggctcattgcccttcaccttcccctccaccagccctccccattccctctctaagggtcaggccgaccactgcagcctgcagtgcctcacacaggtctctcctccccaggagtcgctgttcttgccccaggacccttgcacagggtcaccactggaaaccggggagggtccatctctcccgggtctgcttggtattttccagtgtattcgcagattcttagcatgacacttccactcggcagaaaggacagggagagaaggctgtgctttagggcgacggcagcagggccagctggtgagaaccatgcacaagggtggctggcagagggatgtgacatgggctcccaaacaggccaggggacctgaggcccaggatgccacctgagaggctggggagggcagctgaaggagggagggggcagggactccccccggggccagcccacctgctgttctcgcagccctgggcccagtgatgtggggctcaagggggcctcacctggaggtcagttggggagctagaggccgggacaggagctgagggccagaggggactccggagaacactggatcaagtgccatcagctgggctagttgaagagttttgtgagggtttttgtttgtttgtttgtttgtttgtttttgcgggaggggtggaacaaggaccagcatgcagggcaagatgaggcctgagggtggaggggacagaagagccctgccgggacaagggacacagggacatcggttaggtttggacccatgcacaagggctcagccacgctgccagtgccagactggccccccttcctggggcgtggcagcacattcagttatgggcacaggcaacggcaggggccagggctgcctcgagcaggggaggctgggcacccagctgtcctgtgaggacacaccaccccaccctcagaccgtgccactggacactcacatgacccaagtctggccgcttgctcactggcacccctgccaatcatgctgaccttcttcccactagcacctgctgggagctgacagaggtctctattcccagccaggcgcctgctcaggttatatttaggccacaggggtgggagctgggcctctgacccccaccatgcccaagcaggggcagctgggctgacgccgtgggttgctcactgcctgcagggcccctccctccaggccttgtcctctcatccatcggccatgtgcaggctgggaggcgcgggccggccatgcttcatatgggaaacaagctagtctggctttgagctcctggcctcgggacgatgggggctgatggcaccagaaactctagggaggccagcacaaggggacaggcccgggagctcaggttgggtggggggctggcgggaggcccagcccagcctttcagctccggaggctcagacgtgccatgaggtcattccctcctgggagctcccagagccctgcccgaggggatgctgagccccaggcccttcctgcccagccggggctggatccctcttttccctcctgctgcccaggcaggatgtttccagggaggaaatggctcctgggaggccaccccacccccgctggagtctagggccacttcctgccccgcatgggccttggttctgcccccagtctgccagcctgggccagatcccagatttcctgtccctacagcatggagaggcagaggtgtctcggcctcaaccagcctgggaggcacagtcgcaacctcctggaccccaggacctgagaacctccccctggagccccacttcccttgccccacaaccctggtcagagggaggcacgacctgccctgcccccatgcccagccttccccagcgccacagagcctccttcatataggttccgcttgggtaccagctgctgctccaccgcccatctccatggggcccgcgggcctgggccatccccagcccaccccaggaagctgaatggctgcatcgaagctcccttttggctacaatcctgcagggctggccttggaccagcgggttagcctggatctgatgggccctcctagcagaggtcatcacccggctccgtgggcagccccatccccaggggaggtcaatcagctcagtcctcacccaccctattcaatggggcttcctgccgaccccagatctgggtgagtgtcctggtcaccgccccctcgaccaccaccccatgcagcaggaaacacgtagctggggggttgtggggcttcaggactgggattggagaggctgacagcagggctcagggctctcggcggaagtggggcctcagcccactcagaggtccaggaagtgggggtctcggaagcttcctctcggccagacgagccggagggtcagaggcctggccgcagctgccccttcctcttcggccagccagctgctgggtggcccgtgctgcagcaggcctcaggttggggagctggttgtccttcagcccccgcaggtggccagcatcaggaccggaaggctctgaatcagcctggtctggaggtatgggcagctgtgggggccggtggacaggtgtagcagagctcagggcgcacagcaggggccatctcagcctgggcctgtgttcccttcagtcagacctctctccagcctcggcttgcccatctctccagtgaggtgacaatcccgggcctgaccagacaggctgaccaggacagagaaccctggggccttctaaggccactgccatgtgggccgggtcctgtcagacacccccagccctcagcccctgacccatttctgttcatgccctggccctcctgcatgcccacccaaccccactggagctcagagaccctgcccctccaaggccttttctccacagccaggaccaggcccccagatctggtgccccatcagtcctgccggtacacctctccacagaagaagcccagacccaacccagcctgcgtgagccctgctggggggcctgggccatggaggtccccagccccatgcttcaggggaccgcagcccagtcaacccaggctgcagaggtgtgaggagggggctcttgcccttggcaactggcaggagctgaggaggtgcccgggagaccccatcctcacagatgctgtcatcctggcacatccctacctgcagtggggacctggacaactcatggaaccagtgggagctggaggctccaggcattgatgtgctgggcctcagtccctatgggtccccactgtgggagtgtctcagagtgggatgaggagtctgtgtccgtgcctgggccgaggcctggacaggccccacccccggcccacacatgatgggcggtcgtccatcagcacagccagcccctctggccatccatcaccagccagcggccacaggaggaatggcctgtttgttttgccagctccgtgtcactccctggggcgggggctggaggaaatggccattttctgcctgggcgggcgggtggacagcaggggtgggcagggcaccggggacagggatgtggcaggaccctggctcatcccggccctgcatagatgcccacagccttgccctgttctgtgcctcagtctcccctctggcatcagggtgagtgacactgggattttctgactgttcccatggcagctctctccagctgggtcactcacccctgccccttgccactgggtagggtgggctcaggtgtcagctgccaccaggtggggggtccccctatctgaaatccaagatgcttgatgctggctgttcttataaaccatggggggaggctctggagctaggtccaggccataggccaactgttgattggggttggggtgggggctgtcaggaggtctgaaagggcctgggcaccgatttggagacttccagccttaagatcagagcaggggacagttggggccacattaaaaaaggtagcacgtgtagaatgaagggggagacatcctgtaccaagaggctggtgtccagaccccgggactgtgtcctcagcacctgcacaatgaccctcactgcatcctcatggtagaatttgcagatatgatgtagaggtgtgcgtatatgtgtgtaaagggatacatggcaggtataatttgctgacaccatgctagggactctacaatcattttatcacttctcacaacacctacaaggctccggggagtcaaactgggatatttcttttaccactgcagcctcagacctctgccctggtccctgatccagaacacagtcaccccacactcccctggtcctgggctagcaaggagggctgtggaggaggcaagcaagctccaaagtgcagcactgaggctggggcggagacactgagagtccgaaggcacctccatccctaggaagcaaagccagacacccaattctggagtcagaaaaaagcccttcaatttccatccctgcagcccagtgtcccaccaccctcaggggagaagggtcgctttgctctccctggggcactgtgtttgcttacctcccaggcagctctgatgttgcatagctctttttcatttaggagcagtgacttccttcccgaaatttcttcccttagacctgggctgcttcctctgaccctgcacagccctgcagatgtttgcagggtatcgccctattttatctccctagactgaaacatactctgtcctgagttaagactctggctggttgtagcagactttaaggaaagaacttaattgcaaaaattcactctaagtgtgggcgtgactaagactcattgtgtcttgaatgtgcagagatggataggaggagctcgggggttagtgacattgaggccacatgagggaactctcgtgaacactcagttgaagggttctggagttgggaggctagtgaaccagtcccaccagtgcagggctgacggccctgtgtccagagacccccaagcccagcctgttccttgagccagggctgccgtgcctctgcccagcctccagctcacgagggctggcttagcgggattcatgtgccaccccctcggtgacatctgagaccatgcacgtcttggttgtgccttgttgctctctgctgctctacacagggagacaggccggctggtcgcctcgggggttatcttccctggcccccgaagccctggtgaccctgagcctgacccagggggaacaatgacacaacagcaaatgccctggggcgagtgccaccctgacagccccaaggaacagagagaatcagcagggtgcagggctcagcaggtgcaaggggagaaggctggcttatgtggtggtggggacagggcacagggccgggagggaggggacaggtggccaggggctctgtctacatgggagccacatgggggtgtgggtgggcactgcagagaggggccctggtcatggggtccacaggagagccaagccagcctagaggatccagggatggcccaggtgctcctgccccacctgttccaggccagctgtgtcaggggtactgcctccgtttctccaggctgggacctccactgcagtgggtacattggacactcagaccagccccagggcctggcagttcctggtgaagactgagacagcccgacacccgtccacacccccgcccaggatggggtggctgctgggtcactcggtcctggcaaacacgctggagggaggggctggattgactttagggcactggtaaaagctcacatccatctgtccacccagaacagctggtgccaagcacccacttagcaggacagggcagcccgcgcctccacactgcccatgccccctcccgtctcccaggacgtccacacaggagccacatgtgtcctggacccacgccaccccccgctctgtccctctgttccctgagctgggctggcaggggaagctgaggtgtacagggatggccaaggcctcctccctcccccctgcaccccctagccccattggcattacctcagagcagacaacagcttagtggggacccaagtgagggggtgtcagtggcccaggccctgccctgcccagtcactcaggcagctaagagagcaggaagggcccagacgacacccccacagacatatgccagcccctccgggtgaccaaaatcatctcagtaaaggcagatgaggccaagcgaaaaggggtgggtggaagaaccggctctgagtctcagcccacagacactcggacactcgtcggcccggtaggcaggggttcctggtggcctcaggctgtcaggcccggccccctcccgcagctgtctccagctcccacctcccccgcccaccccccaggactcctatttcactgaggagattaagaccacctggcgagaacccctcccacccctcccctctccccagccctccctcctaaccctgtcggccccttgaggtgccctcccggccccggccctcctctcccatccccacgttcctccacggcagcctccacgccctgccctgccctgccctgccatgggcctgaggatgtccccacccgctctgatggccacctcgggtcacttctcctcagcccataccctggcctaacccccaccctgagcctccagtccctccaatcctcaccctttatgtcccccagccctgcatagatacaggcatcgtcaccagccacggcaatggatcccgtccacctcccacccggccactccagacccaaattcagcactggcttcagcctcctgccattcttgctgggtctcaggagggaaccgggccagccaggtgctgtctgggactgtaggctctgagcctggtccctgctcagttccagcagccagtgggccaggggtgctcagctgaggacccccactccatccagcctgccgtggggcagccggcctggcctgatgctggctcagacagactcatgaggaatctgagctctgaaaaccgcagctccgagcttgcctgtttgtttgcttttgagaaattccaacctggttcagcagagccttggaggagggaagggatttgtcaggtctggggtggggctggggcaggcttgtggatgtggggaaaccaaggctgaatctgggcacagggacccagtggggaagccgggagagggtgcctaactgggcctcctggggggtccagctgtgattccccctccccaaacctcacgccaggcctggaggctccacaggggctatggaggcaacagccaccctactcacagtgctgggaggacctgcggggctgggaggggcccaaggaggccctgcagcaacaatagtgacatcagctggggagctgcaattgagggcccacatgtgctggctccatccacccatggggcctgcagcattctccccacttctcagatagcatcactgaggcttgcagaggccagggcgtgttcccagacacagagccctgaagggtgaagctcgctcctggacccagctcctgagactgggcgacatcaccacgctggttcctccctgtgcagaagggcccagagtacaggggtcctgccgaagcagtcctgttctcctttgaaatgaaatattgccagccttctcaccagctccttcccctgggaaggcgggagaccagacagagttggcagcccccagccctgcatcgccaccccgaccagggaaagctgcctgtgcaactaatctctccaggccccggtccccctctgcccacgggcttggggatcctccacaggtctcagcaaaggggttcccgtgctagagccttgcccatcagggacactccccaaaacctgccccagcctgggcagcccacctgcctttggccccaggtcagtgagggcgcctcaggtcagcccccacaagcacagggggagatatgagcagggtctgcccagagcagtgggcagggaggctcaaatgccagcctgggcacctgggcacagtcctggcctaggagggacaatccagcagccttgggggcttggccagggagcagagtggaccgagaggcacagggtgtggggccagtcctcccctccactgagacaggatttccacacagtctctcccagcagtcacactgggctgtcacagtgacagtatggactacttgaatcaattgagcatttaatgaaaactgcaagtgtgatatatttgactactttaaatgctttaagcatctttaaagagagatacaacatatccaatgtttacgggggcatggcctcgttaggacccattaacaaaggtgctgaggtcactggcttagttgtcattcctcattgcctctggccctgtccccagagccttccttctcagagcttcccagggctcattcgccaccaagcaagattcagggttggggtctgagcatggaaagtggcctcccaaggagttccacccagaaggttctctgtagaccgatcttgtcttgagagtctcttccagtaccaatgtccaaggaagcaggctggccagtcggatgccatcatccgagtgcatccccttcagaaatgacccagcaggagaggactgaaatattgcattcttccttcctcacacagcagcaagcttccacagtgcttcgcccaagtcaagtcaatccaaggcacatgtgagcatcgtcattattgtagaagggttacagtggccactgtgagtgataagcctgcacatgtgtgcgcctgtatgtatatctgctacatgtgctgtgtgtgcacactctctcacactggtgtctgtgttggtgtctgctatgtgcatgtgtgtgcccatgctcacgtgtgtctatgtacagaggtgcatgcatgcccgtgctcacgtctgtgtacatgtagagtgcccatgcttgcgtgtctgcaggcatacagtgtgcatgtgtgcgtctgggcccagtccgtgtgtctgcatgcagtgtgcctgtgtgtgcccatgctcacgtctgtgtgtctgatatgtgcatgtggacacatgtgcccatggtcacaatattggtatgctcacatgtgtaggcatatgtgcccacactcccatgtatgtgtgcctgagtatgaacatggtgtgaacacacacatacactcatgctcatgctcatgagtatgtgtgcacgtggtggtgtgggtgcttgaacatgggcaaatgggagctactgtccagtcagggttccctgctgcccagaggaactggaggggcctgtctgcacgtgtccatcttctggccactcaccctcagccaacactcctccagggtcttttgggacaagtcccttcccctggcaagtgtggctccccctgctggggccacagaagggaagggggctagcagggactggttcctcagctggcccgccaggctgagatccagccacctcaccagcctgcacataggtcttccagggtctcagagcctcacctctgcctggctgcacctggggtggaggggctagtgtggccaggagatggacagacagatggacagccagctccccatgtggctgggtcctcccaccaagtgggcagctaaatcaacagcctcagaaattggagaggggtccagggctgggctgtccatcagtctgtctgtttgtttgtttgttctggagttgtgggaacttccagtctgcagggagtcctggtgcctggcgaggtcggggggcagagggtgccattacccatccggccagccatccctctcatcatctccccacatctgtcctcctgggaacttggcccagaacatcgcacccatagttgcgggggacagctaggccgggtgacaggaggttggggaccagctgtatgcggctggctgtgcagaccctggccggccccctcccggctgggaggaggctggtgtcacacggctgtgtgcttccctgtccagtcttctctccacccattaccccatcccatgtctgcctctctcagggtctcgctgttctctttgtcaatcctgcagtcttttgtcccccagggtccaggcactaggactctcaggcgggtcagaccctgccctgggaccagggagcagatggtgctggggcctaggaagagtcccaggggatgctctgggccgggtgagggggccacacctcctgtcatcctgtccagtgtcctcccagccacaaggtgtgcacaccaggctgtgtctaactcccaggcctttgccagctatgtggtcagcctggtcctgaccagactcacagggacacctcctccaagccctgggccccttcctgggaacgtggctgtgggcctggagctcctgggcagggttcctgcctgctgtctgacacaccccccagagcttggaaccagccagagtacccacgaccccagcagtttgagtaaaggcccaacaccaaggagaacacgtgggggtgggcttggtgaggacttccgtgtcaggaggcgggcgccagggaggagagaggtccagggagggcaaggtcaaggagcagtgggaccacctgagccacaggttggggaggactcccattgagaccccaggctgggtaacaggaacggcctccttcttcatcgcaggcagtgtttgcggtggcacaggagatccggcggtggacccaaatgcgccctgccctggcaggcagggaagtagaccgcttctgtctccagccctccctggaggcggacctggcccctgttctggctctggcttgggtccctccactccaggagtccccagcccccagttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggagggacgattggggagcgcccgaggctgctgtgttggcgcccgcccccgagggctgggagtcaagaggtgggagtggagaggggaggagagggcagagctcctgggcgcgcggtcctgtccgggttcaggcgaggtttgggcccccagccgcccgcccttctctggggcccggggctgagctgctgatggcgggagggaggacggtgagggcagctcctggcggcgggccttccccgagaccccgaggccgcgtccaaatagggcgctgtaagcaactccaggcggtccatcctaaaacgaattagcagggtcaagtaaagcccggctcctcagtgcttccctttgcacggtgcgcggcggagcccgattctgctctctccatactctgaggcctagaggaggagtcccccgtgcacctcgaacctccggccggtcccttctgtgtgtatatttgccccaagtagcctgggaccaatgctgggggcgcaacttgcctgggaaacacagcccagcccaaagatcctggtatactgtctgcccaccagggacgcacgggaggtaaaggagggtgcgcggcaacccagcggtgctcagaattctgagcagtggggaggtgctgtgcctttatggataggaggggaagggggtcctgctgggtgggcgtgagggtgcctgtctgaaggctcccctgagggagccacgtgtgtgcaggggaggcggaactgggcagacagatgggcggccacaattctccagcggcagcctacctgcgctagggaaaaaaacttctggaattagggtttgcttcacccacaactacgaagactggggtggggggcgagtctcagcacactggactcccttggggcagggctgaggtgcagcccagacagcaaaggccgccgcgggtcctcggtcgcatccctcccttcagcctcctgcactcagccaagcctctgctccccaccccttacctacccgagtggaagccaagcttcggttttccggcctgtaaaatggtatcatagctcccatctcgccccctgcgctgggagaaatgggcgtcttgtcttcgctgcgcattgcatgcggaggagcagatgtctcagcccaggccctagccttgcatcgagccctgaggaatcagaccctgcgacccctagccgcgcctcaccttcctgatccacgcaagggagctcccagtcaggcctcctatcgcgcgggtgtggaggtgcggccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaacaaaacagcttatgagcacctcctactaatttcctcagcttagcacaccctgtggccgttgtccccatcgtccgtggcttcatccctcaactgatgctttcctatgtggacttcccggccagtgctgtgggacctcccctgtagggctggccagcctcatgggctgggctacccgtcccactcagcagtggctgcctggcctcccctctgtccctcctgcccagctcctaatgggcctcccataaaagctgatgcgtgggagccaagccacagctcgctgacctggggaagctgacagagtgacagagggtctcaaggactctccacccacaaggcgggaatggggatgctggcaaatctggtatgaaggttgagaccccgaggagaggcaggcctgggggaccgtgcagcagctgtgcccacctaggaccacagggctggtggggctggcagcttggtagagggcaggtgcacagcaaagttttcaccggtgccggcttgttgtcttccacgctgggatttcacatgaagttctagctaattgagtataagcatttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccggcatcggctgacccctcggtgtctacgtgccaagcccaatctgcctgcagggacacccactgccagaggcggaggcaggttctcctggtcccagacccagggccgtctgttggcctgcaggtaacacgcagggaggaaggaaaaggctctaggcacagctgcttgtctaagagggaccctgttggcggcgcaacgctgggtgagtgctgcccgcccgcggatggggtgctggccgaacctaccttgtaaagtggggctgcacagaggtcagcacatggtggcgcccaccgtcgagaggggaggccccttggcactggaggcagggcctcaccaggcagacgtgccaggacccgcgtccctgcacacagctgcccaccggccagtggagtgggacctgctgcccctctgacagctcctggtaatcagaggggcccactccacctgcaccggaggcagcggctggggatgctggagcatacggctccagccactcaggatcccactctgggccgtgaaagttactccacagaacaccccaaggccacccctgctggctgtgaagacaccaccaggcggacagtgcccagggctggggctcacagccacgagaatctggatttgaacagaaaaagcccccagccgcgctgccaccctgacgcagccttgtggggccctgagcagaggaccagctacgttgtgcccgtgcctcgacacatggaaattcttccaataagaacaggatggtgggccgggcgcagtggctcaggcctataattctagtgctttgggaggctagaggcgggaggatcgatcgcttgagcccaggagttcgaaaccagcctgggcaacatagcgagactccttctctataaaaaaaaataaaaaattagctgggcatgatggcctgcacctatgtgggtggtcctgagcttctcgggaggctgaggcaggagaatcgcttgaacctgggaatcagaggttgcagtgagccgagactgctccattgcactccagcctgggggacagagtgagactctgactcaaaaaaaaaaacaccccaaaaacacaggatggtagaacacacctacctgagttggcactgaaaatggcaagaaatgtccgccgttgtttccaaacaccaagttctctctggcttgagaggcctcactgctacccaagagcattatggaggaagatgtggaagggctgcctctcccagttggtgggttggccaggggcgtgatggcagcgaccagccatgctgccaggagtcgcctctcaggttcatcccaggagctgcatgctgaccttcgcgtgctgcctccgggccacccctcctccccacttaatgccttcactgctggctctgttggcgttcctgccagcctacaggaagtggctgtttgctaggaagagaatgccaatgttcaggtgcatcttttccaagctggatgtctggagctgagaccgtttcttcttctgttgtgggggtttcaaggctggtcagacgcatggtgattcatcacgacccaggttctgttgacacaaaggccgacctgtccagagccacatggctctgctgtggacaccacggagcagctcaagagaggaacaggaccaggagggctgcactgctcttggccggcttggaccccagcaccggttctgctgctctcccaggcagctcagccaggtgaatgaaagtcctgggcctgccctccacaggacgtctataaggcctcagaagctggatctgcctggcaaggggggccctatctgcctagccacccagatgcgggcacgtggccccgttgtgcactggaggggtgagggctgtgttaggcatgcaggactcacgctgtcccgactccatccctgcacactgagattcagaacaagatgtgcctggacactgctcaacgccacatggcctggggcagggagctcaaggccaggctagggggcagccgcctgccatccaccctgcttgtgcctttgactgaaagcacgagggccaggggccaactcagggtctgtacaccctgcccacagctcttcatggcctctatgtaagacatcagcaggcagtgccactcgccaacctcatgctggcatgcacacctgggccctcatgtgggatacccacctcgtggctgtgggacgtagggagttttgtaactacagtgatgatgccaaagatgacagggacataaacaggggaaggggtagaggcccagaaccctcagggtgggagctgaggcggggcagatgtgcctttggcaaggctgtcaagggcatgcagggaaactgcaaagccaattcccactccacctaccctgccgctgtcatggggatgtcagaacctgacaccttccctcactgtgacagcctgtgatgagcacccagggcacagctccctcagcacctgcagtcactgcagcctaaacccaggacccttcccctccctgacacctcagtgatatgaaaatacctcccggagtgccctacgcatcctggcggctataggacactcgaggaaaagcagcagggcccccctctccaaaggtcctgggcacctggtggccacccttgtccaacggagccaggccagtacccgagccaggtggtctccaagcttgggccaggggccgctttcccggccagcactgacattcccgtttgatggaacggtccccatggtacctctgaccaacagagaagtgtggtcacaggactcctcaaggactccgggccccccagcaaccatgttcctcacagtggggttggggaggcacggccttgggaccccctgcagtgggtgcacaggtctcactgacaaatccaacacccccatccccaggccttggaagccctcctcggctgtaccccacggcggctggccatgtccacttcactcagtgcagccaccctcaggctgtaatccagcccccacccccagcccggcactggagccttcctggccccaagctgcagcgcccagtccagccctccgtttggcaggtctgttccgggaactcccctgatccacccctgctccggccacctggatcccacacccttccgatccgtcccacacatgttcagatttctgcctggaaacctggaaatgccatgtggtcctgcaggaggctggtgccactctcagggtcaccctctgtatctcatcctgggggtctgctggactcgagtctagttctaggactagaagcccaggtgggggtcccaaggagcatcggcagggccttgcagggcaactgcctcaagggaggccaccccgggccttcagctagaggggctcttccggcaatccgggcagacacaggcgtgtgtggtcccagcttctctggatctgcccatgggccccactccaatattcagggtcatggttctttcccaatcaacacccgcttttaggaggagacgaccggccaggctgggcccggctgcatgcagtgtgaggctctggctgctaagtcctgctcttgctgtgttgtgccctgggggccaccctgtgtgcagccgcagctgtgactgtggccttggccactgtgaggcggtgcttgtcacactcccttgctgctctcgtgccttctgcccagcactcacctggaggtgcaccctgtgcgccttccccactgcaccctctgcgggcaggcgtgccctcccggatcccacatctggcctggccctgtgcgctgcaagccccccttgccgtccctcacaggcacctttctctgcttcactctttagggagttcagttacttcctgatcctgatcctggcctcaacctgtgtgttgggagctcctggcctcctcggggtgaggggtcatgtggacatcgacgcagctatggttggggcctatcatctcctgaggcctggcccaggaaacccacactcggggtggcccattcaacagcaggtgtgagggtggggctgagcatcctgcctggtgggggtctgagggcactgatgctaagtgggggaccagggcctcctcagggagctcccacctcaagcctgcaacttggcaatggaaatttattataaaataccctcagctggcaacacagcaggcccaagccaacgtctcctgcaggcctcggacggccagggctctggctggcccccagagtcaccgtcctgtgatgaggcactccacaaaaggaaataccaacctcatgaagacagcggggactccatggtccttgggccatgacttgctggtcctcagaggcccttgaggtttcaggccaaggctggggcctgatgcccacctccctgcccgccctcctcgtctcccgggaagggagtgggtgagtcatgcgcgtgggtagagtgaccagaggctgatccgctgatccttggagcccgcggccagcaagccatcggcggtgaaggccacgcactggacagcggcgctgtggaaggccagcacggccagtggctgcatcgtccgccagtggaacacgcggatgcggtggtcccagcctgcggtggccaggatcttgcgatctggccggatcgtgacctcggcgatcccgggattggtgagttcatgagtcccacgcacctgtgagagttgggagaggtgttaggccactccttaagcccacaaggcagtgctgcccctggtgccccacctgcagctggaaccaggagagacgcaggcccacaggcccgggatgtgagggccacacgctcctacccagctgacctcccactcttcctaaggccacgatgggggactccagccctcccctcagagtggtcttcggccctgccctgctgctcctcgcaccagctctgaccgactccttccccagtcagagagcagcagagacagggaggtcccagctgcaggagaggggctgggtcccgggacccctcaccccagggaagccactgcaccctagtgcctagcgagaggccacgtcccgggcttgatggcagcagaatgctggcactcctcccagaagaacctcacaaccaccccaaagctgacgagggtgagaaatacaaactccattttcagcaaaaccatgaggtatgtgaacccccaagctcgacagggctgggagcgctgccaagagcaagacccagtggggggttggcaggatgagggggggacaagggggagacgccctggaggcggcaggagccacacagtgtaccttgcctggtgggggcaacgtccccggctgggttctgagagggggtagggcactgcacgagacccggagccacacagacaggtcctacgtgcacggggccgtcggggtgctggcctcttcctgggccgagcgttggggccagggggtggtggcatgtgcctgtaatcccaactactcgggaggaggatcacctgagcccagtggatggaggctgcagtgagctgagatcactgccaccgcactcctgcctgggcgacagagtgagaccctgtctcaaaaaaaaaaaaaaaaaaagatacgctctaataaaattattagacttcatagctaaaaaacctttggtggccagacaaaaagaccatgttgatgagggtgctgtttaggccgtcctcagaatgctccacagccacagggtgccaagggatgacggggtgatgcctgcaaggctgaggaggaaggcgaggtccaagtattttatatccagccaaactgtcgctcaattataaaaacaacagaccaacatttctgaacatgtaagaactcagagaatcctgcacccataagctgttcttgaaagactagaagattaactccagtctcgtaagagataactggagaactgcagcaaatggtctggcagggagcactggacccacttgcctataggatcagctctaagacaatatggggattacggctatggaaccggttattataactcacagaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaacaagagacaagggacactttgtgctgagaaaaaggctctgcaccaagatgaggtgacatctcagcgcctatacacccacactgagccccagagcttcaaagctcatgaagcaaaactggcagagacaaagaaacaggcacgtttgcaatcacagttaaagattttaagagccttctctgcgtaactggtaaaaaaaaaacaaaactagaccaaaagatcggtaaggatattaaagactggaaccacgtccactgacctgggtcaggctgacggaaggctccaccccacaactgcggaacacacgctcctttcaagtccatgtggtgcactccccgagacacgccatgtgctgggccaaaagcaagcctccataaatttctaaacactgcaattgcactgcgtgcattcactgacaacagaattaagctagattaaagatatagctacaaaatcaacgaatatttggaaattaaataacacacccccaccaaggaacctacagatcaaagagaaaatcacaatattctgaactgaattaaaatgaagacacagtaagtcaaagccaatgagactgagtcacatggaaggtggccaggctgggagctgaattctcagcagcccagggaggtggcaggacctagacccatggcccagcagctgctgctgctcagagaacggcccctcagcatccaggcccgtgcatcagaggccaccagcacagccaccaagaggcccctgcctgaggaatccctaaaggatgcgctttttggcttccagaaggaggtcttgagatgtaagaacacccagggcaacgctcacacacgacatgcaatcatcgatgtgagaactggctccataagagatgtgtctacgcctggagggccaggaaggttggaggtaaaatgattaaaatgtaaaggctataaagggaagtagtgaccaaaagaaacctggactgagccatattaatagttggaaaaataggctttggggcaaatgtcctttctagagatgatgagggggaatgaagaaaagacctcattcaccaggaaatcaccattttaaactggcatgttcccaggccagcttcaaagtgcataaagcaaatacagacaggcccccagcaaaagggaacaggacaggcctctctgcgcctgctggggaccatggtgacctgcaggatgacttaaagggctaagaatcagtggacacacgggcctggcgcccacgtgtgcagcggggcatctgacaaccagcactgcctccctggcacatgtgcaatgcttatgaaaactggacggccccgcatttcaaagaactaatatcattcagaccttgttcccagaccacaatgttaattaagttagaaattgaaaactaaaaaataactggggaaaaaaatcaaacattcagaaccataaaaacattctaattaactcagcagccagagaacaaataaaaatggggtctttgtgtcaaatgaggaatatggggaaaaaataataaaaatggggtctgcctggaagtggggggaggaagacaatgtcttcttgcaccagggagcccagctggacagtcacctctggaaacaggctccatgtggggctggcaagggaaggctgagtgccgatgggctgtgcacctgaccccaggcagggcagcagatgcaacccaggggacatgggatggagggagagcatggcaaggacagaaacaatgaacagaaagatagaaatgctcaaggacaaacgcatacaagactgatcaggaataaagcagggacggagctttgaatgcggcagaaatttaaacaatcatcacaagcagtccaaaaaaggtcactaggaatacaaccttcaggatttgtatgcccacagacaaattcctagaaaaattccccaaatcaggaaacctaaattagtccacaaagaaaacaacctgggcagagaaaataactgcccagtaatggtgcaggcgaagaccaacctacagtcactcacgaccccccacctccaccgcccaaatgtgtccatccatcgggagaagagggaacgctccccaccagctccctgagcctggggctcctgtcactaggcaggtggtgggagagggaggcccaggtccgtctgtggccctgggcagttctggcccagcccagcagagtgggcggagcacatgtcacacacgggagggggggtgggggtgcaggcggtgatttcaagacttttccctgagattcagggacagactgaggattttagttgttttaatgtttaagaaaactccaacaatgcaatgaacagattcaagaagaaaacctgtatgagttggagagatgcagtgagatcatttagtgacatcaggcacccattcaagacccagattctttccccaggaggggtgggaggagcctcgcctggcgaggagatgccaccaaacaacccacagctagcgcagccctcaccctggcctgggataccaccgcctgcgcccccaacactgctctaggctcctggccagtgaggtaggcgccttgccatgccctcagccacctcgccgtcctacctcaacaccagcttgtctctcaaggccaagcccctgcaagcccatcatcctgccctttcaaggcctctccagggcccggggccccctggttcacggacttaccaaggcctgcagccctgacccctctcatggcccctcccctcccaccgcgcactgtaaccagcacagtcccagcacatcccagacgctctgcctgtcctctacctctcttgcctggcagaccttggctctgggggtctcggcggtatcctgcctgtgcacacacaagcagctgaatgtgctgcagcacgacacacagccattggttggcaaccgcaagcccaggctggcctcagtgtccagagcacccggccttggcgctgcctcccctccctccacaccagcccctacctccccacttggctccctgtgacccggctgaggggctgtcaaggccagcacctgctgcgcggggccgtcaagtccagcacctgctgcgcagggccgtgaggggatgctggcatgtacctgtcatgcgtgtggggttcgccgcctgtgcttgcagacccaggagcccctccccagctctcagggaccagaacacagtggcccagggaaggaactggcggctgggaagaacaggaggctgatttgatgccatcgtcacccatttctctcctgtgacctctgccctaagtcagtggtagagagggaacaacaggccacacgccatgggcctcactggaagccactggggcctgctcagggccctcttgacaggaatttgctggcaggtccttcccagggagaaaagagctgccaaatgcctggagccacaggcgtgtggggaggtttccgtagaagtcctgaccagggatcttcacctgtggaggctgagatgcccagttcctcctgcccagctcctgcccagcagcctggctgtgcctacccaccagccaggcggccactgcctgcagggacaggagcgaccccacacccacctcagccattctcagaaagcagtgacagcatcaaggtaaagaaaaccaggttcaaggaccagcttcccgcaggaaatgaggatgatgcgggaagcctggtggggcctcctggagaaagactagggcctgctccagccctgtgttcctgaagaagaggaggactggtcctggccctgcagtgacagcagccagggccctgcactaccgtgctcctgatggcagatggaaacatgtccacgccctgcacaagcctctcctcctgatgcgatgcacggggagctgacccggggccctttggcctccctcctggctgcccagcagctctgctactgccctctaaagggaagcctctggcagacagcgcagcagccaccactgctgtgcagatgggagcgcagctgggacacctggccatgtcttgtgggagagccacggttggtccacttcccagaccagggctgcctggggtgggggagcctcattattacttaaagccctaagaatatggctggctgtaaatcagtccccacttcaaggctgtgggcactaccccaaaatgtgggagggagagggcctgcgtaccacctgtatctgatgacaacacaggctctaactgtgacagctcacgggaaagccgcctcagcaaggcaggctcagggctccagtcaccacttgaccccgaggcaccctcaggtggtatcctgatgtgggcagcctcctcgtcaccaccgcggcccctggccaagccccagcctggacctgggccttccaggaaggatctctggccaccagtggctctcgtagcgcatgacctcaggtgccaggaatgcgtggtgcggcgaagccaccatctggttccgattacccatgctctgctccaggaacctcattcgcgtctctactcccagcacccgccggggggagactgatctgggctcatcagaggcttcggcaggagggtgtgagggggacacagccgtgcccacgtggctctcagccaaggagtcacagtgcaggcggtgggtgaggacacctgtgggtgctgaggaccttcggtcaccttgcttgctcccgggtggcaagaacgctctcaggcagctcacctccgaaagcgcccccacaggctttccctgaggctggggctttacagaacctgcaatctccagggcctctaggatcaacgttaagatgtgacattgggcagagggtggcgcatcagcctctccggctccctgtcccctgttcctggagtcgcctgtcccctcccaggcctcctcctggcccatgcaacacagggctcagcaggggaaacgcctctccttcgatgtgcaccatgggccgatgccctgcccagcacgccacagccacgccaaccactccctgttcctggttctcccttctgctctcactttccaattcattaatacctggtcccccttttgctttaacttttcaattcatcaatccggtcaagttcatctctggactggaacatgccccataaattacagtcctaagttccagcagctgtttcccaaacacaccaggagagacgaggcagatctgggccaggacggcaggagggccccttcctggggtcctgggcacagaggtggaaactgcagagaagagccctccgggggctctcagggaagctgtctgggtcttcagcgctttgctgtcaggctggtgaaggacaagccagtgccaagtgaacactggaccccatgggggcagccctgcaggatccctgccaggcttgaggaggagggagggagtgcaagggagacgccccttccagacatgcagacccagcacccagagtggctctgcctcccagcgcccagagcagctcagcttctagctgctcagaacgggcatcatgatgatgacacatccaccgaccacccaggcctgctaagccttaggagacccttcctcccggggagacatgagaagctctgccgcttacatcagggccttgtgcccccatccccaggacagctgacggatgggtgagggatggacacagctctcctgcaagtctaccatgtgcctgcacaggttggtgatgcccacagggcactggggccgctcacagaaccctgcccctctgtgtatcctagtctcaccagggcatgtccttccgcagctccaccatgtgcttcaaagactctggtggtgcccactcaggggtgggcctgacggacccgaggtgaaccctccccgccccacaggggccagggctgggcaagcgtgaggcgcagcaggcttgctggggctgcgggcaagtctgccctgcctggggggcccgaggaatgccctctctgtggcctcctgtcgtacagacagcctggaccacagccctacagagaagggcagccccgggccctgtccttggtgaggctgggagctgttgctgcttctgccagtagtcacctcacgggacatgcagctccccctggaggcccttcacccactagactgggcaatctgaccactcgctggctatgggtctcaggcttccaagacttctggtgaatgggggctccttgtccaccccccagaagccaggatgtacccaggccacacccagcacctcatctcccatggtctctgcagcccctgagacttgcaccagagtgagacctggacaggagactccccttgcccccaccagcctgacctgatccctcccatcccaaacagggccacgtgtaggccaggccaccctggagccacaggcccagacagggacaccacggtgcccctcgagccatgccagctaggagagcccaggagacaccatgggaagatcttcagcaaccgccaggtggccctgaggcttcccagccttcctgctgggctttcctgctgcccgtgagcaatggcctccctcgggccagctccagaccaccacgggggctgcagctcctcgcagttttccacactggttttttttttttttttttgattaatcagttccttactgaccaaattcctctgagttttcacaaaggggtttgagtattcctggactctgcgtgcctttctctagatggacaagatgtgacggcatgaacccgaggtctgggcgaaacccaaaccatgtgaatggtctgccagcgcccacgcccccttcttcctgcgccagccatggacagcccccctgcacccgcctccaagtgattaattagccagggatctgcaacaactcctcttcatgcctaaatattgtttcagcctatcagactgttagtgcagagcaggataaatgagacccggggcctggcgcactgacctgcagggcctgctgccagtccaggctccagacagccagcgccttccccgcggagcctgagatgcccctggccttctgggagtcaaagtcaaggtccatgacgggctcctcatggcaggcgatgcggctgcacaccttctgctcagagacgtcccacaggaccaccgatccatcctcatagccggccagaaggagtgggcgggagctgcagtcggcctgcggggaacagcagagcagtcagctcctggaaggaccctgactccagtgagtttcgggggagaaggggctctggaaattcctgcccctcctgctggctggggctgtttcccatgtcttccacgtggctgccacagctcagaagctctgcaccgccagtgccctcccacacagcccctggatggctgatgctgtcagcatgggactggcacggctgcccttagggcaccccaaggacataggggtggagggcagagagccaagcccaaggcctcccactgctgtaccacttctcaccagccctgcaacctgcatgtgcccaccctgggttctgcccaaaggggtgatgctgggcacccaccagccactgtgagtgctgccgaccctctccacttctcccatgcacagggacctgtcctcctgcctcctttccccaggcctaagatgtgtggccaccacttactggggctggtcacctgtctagagccgccagccagaagaaaccgtgagctccatctccatgaaaaatgaactctctgtgctttgtcaaagtggctgccgaagcccctgcccctgaagcctggcgtgagccgcccgagctcttgtgatgaatgagggcgcgggtcagagggctccaagccctgggcagacacctcgtttgttaagcctctggaataattgcaggaggagagcactgcaggattccgcatcaccctggggacacagccgtcagtccccggcaccaagaatgacagcccagagaaacctggcatggctgagcaaggagacctgagggagccagaaggcaccagggcgtgtgcctaacaaagggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcgagtggcggtcagtgtgtcttctcccggggcacctcctcccaggcctcatcccaagtcatgccccgctgccagagtccacattgtccctgggaggcagggctgccccagggccccgagtgtactcagccccctgcccctccctgcagaagtcctggccacgctcctgcgtgtgctgttttatccctgggaggagttccatgttggcacctttcagatcacctgctgggaaatgaggcgtgcagggacccacagtactttccttcccaacatgggcaccatgccttctgcacagaagctccttgcaggcagccctggctccctagaagggcctccccctggtaagtggtgcgtctgaactcacagtgggtgagggccaggcgagagcagcggggaacactctgcatcccaaccaggaatgcaggccaaccccagaagctgactccaaagactctcctcattggacccactcccctcaggcagcgctctgtggtggcacctgttcccagcctgtgccaccctcctccccggcactttcctccactgcaggagctgagactgcctggggctgctcccatcaccgatgtccttctggcagtctcagagcctagagcctgtgtgaagccactgcctctgaattcagatgccatggccaacgcagggactgtgtgtgtgactgacccgcctgtcgtggtgccacagggtggctggagcagaagccaacctggcctggaggggcttgccctgtggttgccagcccctgctatgcccctggtccctgcagccccctagtgacagataccacaggccgggcagtcctcttgtggctggagcacttcggtgcccacagccttgatgctgcctgacctctgcaggggagaggatctgaagtctcctggacctgttcttctctgccccctccctgcccgcagatgagacctggaggccaggcctcattctgcacccctcccattgactggcacccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttcagaaaaaaaaaaagcaagtcaggccactgtgccacaattggattgataaattataacctgaccctcaggcttggggatggaaaagggaacatgtggagttaatgtcggcttttcttagcggaatgcttcacgctggatctccatcaccaacagaaacacgatttgtcctctgtcaactacattaattaccttaacaagtttgtacatccctttctacgcatttttctgttggaattttacatgattgtgcaatgacccacgtttcccaaggggtggaacaggagccgtgcagactcggacacccttccccaggacctggatgccctgcccactgcctgcggggttgcagccttggggggcgtttttcctcccagcggagcccatgtcaagcccttggaggagccttgtgtgggcacatggagcccagtgacccaggctctgctgcagtccctgtggcccggctgtgagcctgctggcaccgagtttcatcatctcaggtgagcctcccggaagccaccctgcctcctgtgagggcttctccccaaatggccacagccacagaagcagcactacaggatcagtccacgggagaccccaaattccaagtgaaccttctcagtcaagaaaccacagggggaagctgactgcagtaaggggcgcccactttctggtcacgtggagagagagaaaagctgggggcagggactctgggggtacccatcccggtgggccttgcagggcatgcagatgcccacaaactgcacaggcccatccggtctcgctctcatgaggaggtcaaagaggcagcgagccagagtcacctcccggtaaaggcccagcccagggcagttctcagagccaaacagaaaaggagggtgcctgggccgggcgcggtggctcacgcctgtaatcccagcactttgggaggccgaagcgggcggatcacgaggtcaggagatggagaccatcctggctgagatggtgaaaccccggctctactaaaaatacaaaaaattagccgggcgtggtggcgggcgcctgtagtcccagctactcaggaggctgaggcaggagaatggcgtgaacccaggaagcggagcttgcagtgagcagagatcgcgccactgcactccagcctgggtgacagagcgagactccatcacaaaaaaaaaataaataaataaaatagaaaaggagggtgcctggcatgacttagggcctgggaagagtgctgctggtgaccccttaccgtgggcttccgaggcagctcagggctgaggggctctttgcaagtgaatgcacgggatcacttgctctgcagccctggacatgagcggccccgaggagggcagctacaccttgagccagtgctggcctgaagggtgatgagggaggagactggcctcgaggaagctgtgctgcatggaggcagctggcccagaagagtccctcccagcaaccccgacctgtgccccggctgatgccttccaaccctgtctaaccacaaagaacagttgagaaggaaggaaatgttcatggatcagaaattccaaatgtggcctcagggaatgtcattgtgttaagtccactcctgcctctaagaggcaaagaagtaataaaaatcaatcctaagcaaagcgggggccgtgcaggcttgctgcagttagtcagcgtggcctgccctgccctaagcacggcccaagtactgaggcgctggcagaccccactgtcccctcctcaccgctcactggagggcaccacgagctgcggggtgagcccaccggagcttgcaaaggacgaggacctgctgccactgctgctggctgaagccaggcctctcctggggcactgacaggaggccccttgcagcagcaggaagcagagggccgtggggacactgaggcagctgcacaggttccctgcggcaggggggtggggtgttgcctgagtggctcgacgataaatcagatcctgaatggagcatgactcatggccgtgggtgtggccggcagggcgtggctggtgcacgcggggccttacctgccacagccgcaggcacatgggcatgcccagcttggcatctgccttcggcttcagggcgcacactgacgtcttggagggcatctccagaatctgaacctgacagtaagaaaacaagttgatttgggccgtcgccaagtcgagtctgcgctatacaaacaagagactcttaaggcgattagcccgggctgctgtgagtttctgtctgctcccctccccgtgggcacctgggagcccaggctcctaattaggctgcatgggcccttgcaaaacgctctcactgttcccaggtcaccgcctggcagctgccccagcctctcccgacgttaccgtgcaggctgagcaggaggctggttcactggcccctgacagagcccaccgattctctctccttcctggtgtaggctttacatacgaaccagtgtgagtgatctcaggcatagccatggttctaagactcgcccaggagcacctagggatttgccacccacttgagaaatgaatgtgatgtgcgtcctctgagggcagctccgggaaacctggctcccccacctggacgccccggtgtcccctgtgcatcgaggctgcattccaggtcccctgaacacaggccagggcccccctacacctgggctgggagatgtgccatgccggcttgtggggtgtaggctcgctggtcacacatctcctgaacagccaggtcaggggatggccgaggccacaagcagcagactgccaggtggttctgctggaatccaggtccgcctgcaccctctgccctcgctctgggaactggggaggctcagccagcactgaacttccccaggtacaagcgagagcagctcactggcccctgacagagcccactgattctatctcctctgtctgcttctccttcctggtgcatgttttacataggaaccacttggaatgagctaccgataacacagcaataatatcaatgcacagccaccttggacagagcctggcatacatggggcatcacccactttacacacaaggagtccaagcccctgaggctgggggctctgagtaggcagaactcataccagttggtccagcggtctctggcccctctattctcctgagccaggcagagggatcgtgtcttaggggcctgtgcctctgtgggtgagaagcttgctgccctcactaacccacacagaataggcccgggaccccaagtctgaatcccagatctgccacaggcatgctatgggtgtgctgaggtcacctccgggcagggcagagagctgggcccacagcccggtccttccagctacagagacctgctgaggcgcccacctccagtacgcggaccagggccacggcgcttcttgtgcaggctgctcttgccaggggcccccacagcagctcagcctctgccagcagggcttctgctccactcagcaccaggagcttagcctctgacagcagggcttctgctccactcagcaccaggagctcagcctccaacacagggcttcagccccactcagccccagggatggctcacagatctaggccccacacaaacgcatgcacacacacatgcatgggtaacatgtacacacctgcacacacaaatagagcctcctgcccatcaagcccagaaaccaggggcctcagggggagccaaccatctgacgaaaggggcccccggggaacaaacagagcaacataatgaagagggcaaaaaagaactcagtaatgggagaggtgattacagtcaggaaccaagaggctcagtgatggtgagaccaggcctgcgagctctggggaaggttgtcaagcctgaactccaaagccggccaaaatggtaagcaggagggtaaaacagaggtctctgtggacaccaaggattccttgcggaaaaaccgctcaaggagaagctctagccacatggaaatataggaacattgatgtccaaaaaccaagacgaggtgccactgagcctggcacagaagaacgtggagaacccaggagaagctggggcgggcttagccgttctttgtcttctgcaagtaacagcaactccgggacagggttcctcctcttaggatcagcatggccactgagtgaagagctagaggcaccagggcggcctgcaaggaccagagttatagcccatgtgccacctctgtgatcccagctaagggagcagtggcaagctgtcattgggtgttgccaccattgtccctttgctgttttcaggaagggtctgtgagagccaccgtcagggctgtggggagggtctgggagggtgtagaccacactgcctggctcactccccacatttccaaatgatacgggagaggggcagggaagtgctaggaagggaagtcacctggcaagggctccacccccgggcctgtccctatagacctaggtgaggacaggcactcctgccttcgcacccaaatgctgcatttcccaagaccaccctggctcaccacacccccattctgtgcctttaaaaacccccaagaccatagcaagcagagacacaagtggctggacgttgagaggacgttgaggggagcacggtggtggaagagcacaccgacagaggctggcatgctggcaggccatcaaccagcgagcggaatgaggtggaatctggccgggcagttggaggagagcccaggccacccagcagcccaactccaggggaaaaccatctcccttctggctccctcatctgctgagagctacttccactcaataaaaccttgcactcattctccaagcccatgtgtgatccaattcttccagtacaccaaggcaagaaccccaggatactgaaagccttctgtccttgcaataaggcaagggtctaattgagctgactaatacaagccacctatggacagctaaactaaaagagcaccctgtaacacacactcactggggcttcagctgtaaacattcacccctagacactgctgtggggtcaaagcctcacagcctgcctgtctgtatgctcccctagaagtttgagcagtgggacaccgaggaagcgaaacacacctccattgcacgccccgggaggggataagggaacttttcccatttcacaacctgttttccccatattaaattgagaagttttgttttgttttaaagtcagagtctcactctgtcacccaggctggtgccatcacagctcactgcagccttgaactcctgagctcaagtaaccctcccacctcagcctccccagtagctgggactacaggtgtgcggccaccaggcccagctaactttttgcagagatggagtctcactgtgttgcccaggctggtctcgaactcctgggttcctcctgctttggcctcctgagtagctgggactatgatttcctactttttgcactcctctgtgccagatttcttaaaataagatctgttcttcttgtcgctatatcaggaagatgggctagttccagcagttaatggggtggggaggtaggggacttaagccaggggcaggaggagccgccctgagcacacctgtgcctctgtggggtggggagggctgcggaggaggcaggcactggctacacagcctacacggccatacacagtccccaaccaaggaaggcctgtctcaatttgggctccaaaagacccctctggggacagtgaggggacatcaagggcaaaggacttgagcaggccagtgagggcaggggcaaaagatggggggaggaggggtgcggtgagggcagaacccagggcagccctgatgccccactctgggcgctgcaggagggagcgggggtggcggcgccttgaaccacatcctgggtgcaggggagtggtgagccctgggcctgagcaccagaggtacacaccacgtctacctgggctgggtcctcagcccggggctgcccctgcctgcgcctgtacttggagcctcctacagacacccatgagctttccgcctggcacctgactgcaacttttgtttccagaaggaaaaatgttaggtttgggcaagtgtggccacccagccggccgagtggggtgggagtgcggctccctgggcgttgtctgggtgcaggccagtgaggctttctcccgcccagtctgacagattccaggtgggaatgtggaaagcaactgttttcccaggatgtgagaggtccccagacaggctgccccgggaaaagacagatgctgccccacagggagagctgaaagctaggaggagggttagacagccttgagcacaggggacgtgtggcagggggcagcgcaggctgaccgagtgctggctggcggcctgggggtggccgagaccagcgcatggagcacagcaggccaagggaagagctgactcaaactcctgcagcattcctgtgggtctgtagaccttgggtcccgggggaggaagcacgcccctctttctcacataaatacaacttgtaacaggtttttggcagattggcaagaaaagtgtatgtagctcctaattggttatttaaatgcaatgaacaaataaatgcctgttcctatctcattatttctgtactggatctgcctgaagacagaacgactctccttgggcaggggccaagcccaactgtgcgtgggggccgtcctgcccagtaccagccccaaagactgcccgggcacagcgaatggggaggactcggcagtgggcatggacagtagcccccacgtgtgcgccccctattccatggtatgtcctccccatgccccgccctcgggccaccatgccccactcaccaggtgggacagtcgccactcaaaggctcttctctgatttcccttcagctcccccaagagctgagcctccagccacaccctcctccactatgacaccctccccgcacatcttgggcacccctcccttggcagaccctgcctcctgtgccactgggggtgtggataccactgtccagctgggccagtcctgtgttaccaacacctctggtcattctggcctaagctccacctaacagtggcctccctgcttggtgatccccccaccccctgggtgttccctagctcacctttcccctgaggactgtgatcaccaccttgtgcctgcacccacccatcccagccctggttgtgtgccctgagataccaccctccctgctgccctgggtcagccctccccaggcctccaacttcaccagggacttggtctctctcccaccgcctcctgccagctgccccggagcgttcctcccacttgggtctaaggtcctcagggcctgagcagtctctcccctgccgttcctgccggcctcgggcctccatgcttggccatcccacgccactgtcctccatgtgcagaactatgctgggtgcccaggcctccaaaacaccggcccctcccccaacgcctcctgattctcccactgccctgggaggatggctcatcagcaaggccaccccaaggggacaggcccaggcctagccggctgtgcatcagccccggctgctgaagctgccggcaggtgggcggctccatggagtcctgtgggtaggcgcaggcgcctcctaatcaaatgcagaggatgagcacaactgtttggagaacatggggcctcaggcaggctggctctcacctcgtcgctgcccctccctggcacggcaagcgtccagcgtggctggcccccggccaggatgctgctccggcagaagcccacactctccaagcacacggagtccacgacagcgctcctgccctccgcgaggtcccacaggcacagcttcaggtcccggccctgactgccagacaaagaggagacaggcctgagactccccttgacaagtgtcagctcccatggcccctgcagcggaaggaaggcaaggccatgtttccagagagtgggtgccgtgagcttggatcatcgcaggtcgggagcctcagctgaggaagggcctcaccgctctggcattgacacttgagccagcaccaaagtgcccgaggccaggacatgcagtggatcaaggctgtggactgatggctgtccagcgtggccccggggtgggggacaccaaccctgcagtgctgcacagcacagagagcaaacttcactgtgtgcaccctaaaaccagcaaactcccagggtgccaggatcccaggaaggactgcagactgtgacaagggggagaacagaggggagccaacctgaggcattttggggtagtgctcatgactagatgcttatgaggttaaagacaaaaataactgtgcagaaactgttccagtgggtgaattagtttctcagaggggtgcaggttacagttctgaatcctctccacgcgtacacctggtagaacagatgaggaaaccagtggtggctcatgggcccggggtctcaccacagggagatgtgacgaagaggcacaggggagacatgggctggcggagtcgaattagaattgtaaagtcaatatgaacaacgagtgtttgggcagatgcacagacagaaatgagtacagacgggtgtgtaagcacaggtcagcgggcacccaggcgtctcccggtgctgtccactgagaacacctagaagcaatgaccacacctaacccaagtcttggtttcttatgctgttctccaaaaacaggaaccagggctctggagaaatggctgagtctagggtggagtggaggaaaaccaagaggagtctcaagcatcctgtagtgccaggcagtgagaaatgcttcaaaaataaaataaggctgggtgcagtggctcaacgcctgtactcagcactgtgggaggccgaggcaggtggataacctgagaggtcaggagttcaagaccagcctggccaacatggtgaaaccccgtctctactaaaaacacaaaaaaatcagctgggtgtggtggcacgtgcctgtaatcccagctacttgggaggctgaggcatgagaattgtttgaacccgggaggcagaggttgtggtgagccaagattgcaccactgcactccagcctgggtgacaaagcaagactctgtctcaataaataaataaaaataaaataaagactgggtgcggtggctcacacctataatcccagcactttgggaggccaaggcaggaggattgcttgagcccaggaattccagatcagcctgggcaaaatagtgagacccctgtttctacaaaagacacaaaaattggccaggcatggtggtgcgtgcctgtagtcccggctactcaggaggcttaggtgggaggattgcttgagcctgggaggtggaagctgcagtgagccatgatcgagtgactgtgctccaggagaccctgtctcaaaaaataaaataaaaataaaaaaggatcggggatgtcagaaggacacggactctgaagctggaacaatctgagaaatcaaataaatcatggtggtattagattttagcccaaagaaagaagtaaatctgcatgagcccatcctcatgagtgaatgtgtattatgtatcagaaagaaggaataaaccttccttccagcttcctatattccaattaaagtagaaatctgccatggctgggagggatgagggaaacgagaataccccagtaataacaggtgcaggcagagtccacagatggatgctaaaatcagcggcaaaagggtaagggtctcaacatgttgcccaggctggtctcaaactcctcggcttaaacgatcctcccgtctcggcctcctgagtagctgtgactacactccccagatgttagtaattactgcagtggttttaacacagggccacacatccttggctctcctctccccaggaggtgaagcttccttttctctttgcatgtggactgcagctagtaagcaaaagctataccttgacagtggagtcaggcagacacttcctgccccagtgaccagggttgtccccggcaagccatgggccatcagggacccatgtgttcagcatggactccgggatgacaggatgagaaacctcacttctgtgggtttcttcccaaaacccatcaccccagtcttaacctgagaaaatatcagacaaacccaacctgaggggcgttctacaaaacatctgggcggtaactcttcaaaagtgtcagctaggtgcagtggatcatacctagaaggtggaggtgggaggactgctcgagcccaggagttcaagaccagtctgggtaacatagtgagactccatctctacaaaaaatgttttttaaattagtcaagcttggtggcgtgcacctgcagttccagctactcagggggctgaggtaggagaattgcttgagcctgggagattgaggctgctgtgagctgtgatcacaccactgcactccagccttggtgacaaagcaagaccctgcctcaaaaaaaaaaaaaagaccaaaatgttgaggtcacgaaaataagtgatcacacaccaaaagggactaaggagacgtgacagctcagaggatcccggagcagaaatgtcactggtggacaaacagaagaaattgaaacaaagtctgggtgccagttattatcatgcaccatgctctgccaggagggccgtgcggtgtgcggtgtgcagttgcggttgtggtgcccacgccacagagaattcagcaccacaaaggccgatctgggcaactcggtcccgtccaaatctccactggggttttggagaacctgccaaactgatgtcaaaatgtacctggacatttggagcacaaagacgtgcacagcccccgtggctctgctaggcggcaaggctcaacatgacactgcagggaggccgagatgggggtgtcctcagcatggggaggggccagggccaagggaggggaggtgtggctgcacaccacgctcatatggagggcacccatgtaagccctgcggggagtggaggactgacttgtttttccaggaactttaacattttttttctttgagacaatatcttgatttgttgcccagggtggagtgcagtggggtgatcacagctcactgcagcctcaaactcctccctcagatgatcctcccacttcagcctcccaagtagctgggactaccagcatgtgccaccacacccagctaatttttgtattttttgtagagacgagatttcaccatgtttcccaggttggtctcgaactctgggcccaagcacacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctctgccccctgcatggccccttctctctccctgtctctgcctctctctcatgtctttgcactccttccttccctggggacgaggcccaggcccatattcctcagatgacaccagtcgtcacgctgcgaggcacacgatgtgacctgcccaccatcaggggtgtcaaccctgatcgcctggtcaggacccatagttttcaaaggctcatcatccctaattctgatcatttattttagtgctcaaattggcccaggctaatgggagtccctgcaggctggctcagaatcctctgacgtggccatctgcgagatgtccagacctagaatctgccatctcccggggaaccctcactcagcttaggacacacaggcatttagaagccaggacctgggtgtccacctgctcactgccagagtgtgccccagccaccaggcccctccgcacacgggctagggaacacacacatgcctcacatgcatgcacacaacacacaatcacacacaccacacacctcatacacacctcacatacatacacaccacacaggcacctcacacatacacaacttacatacacaaacctcacacacacaacacacaggttctttctcaccttcccccttctcgtgtctgtaactctcctctctgggcagggacaaccctggcctctgttatcctggagatgttcactgacatgcccaacaagcgagcctgccacctgccctcaccaacctcctggcctcccaggctgccgctgccacaccacccccccaaccctgcttctttgactgcctggcacccccttcccaccccatccaaggggcactgaggtgggggaaggcgggaccgctgggtacccacatggaaacccagggccttcactgcacaccgtagtgaattccagctgaaccatggatctacaagggacaacagtaaagttcctgggagacatggagagaggtctctcggacctcggtgcaggaactcccggcaagacacaaaggcactctccataaggggaaagcctggcagacttgaatcaactccattaaaatgagtaactttgttcattaaagacaccattaggggccaggcacagtggctcatgcctgtaatcccagcactttgggacgccaaggtgggcagattatgaagtcaggagatcatcctggccaacatggtgaaaccccatctctagtaaaaatacaaaaattggctggacgtaacggcacatgcctcttatcccagctactcgggaggctgaggcaggagaatcacttgaaccagggagtcggaggttgcagtgagccaagatcatgccactgcactccagcctggcaacagagcaagactttgtctcaaaaaaagaaaaaaaaacgtaagaaaaagaaaacagcgacagctgactgcagctacatgcaacacacggagctcacggagataaagttgagtgagagaagtcacacacagatgctgctccttatgtctccacgcttccaaagaaaaaagcagacaaaatagtctatgcttttcagagacatacattcataaatatagcaaaaatgaggcgtgaggggctacctcctggggcatgaggggctatctccagggagagcaggtggcagcagctcagggattcagaggctcgggggccctgcgctctacttcttgactggaaggtggttgctcaggtgctcactcagccgtaatacaatgctctgaacacttgtcttgcactcttctgtgagtacattatacttcacaagaaaaaagattaaaaaacaccctgccgaggtggctgtcgaaggcacaggtgtgtccttggcatgcgggaggctgagggcgtcctcccacctcccatcaacatgaaagccatcacttccttcaagggccacttggagagacttggcttccaaacacagctgagcacaggccgggtggcggcccacaggctctagtacagtgcagacgcacctggcactccacacctgcagtttctgtccacagaccccctgacccgtggctggctctgcctgggaagcagccactacagcaccatcccagcaggaaggggaggtgccctcgaacgtcagctcccagaccgcccaccaggcctggcacagctcctgtctgcaggacagcctgataccacaaggcacctacgcaagggaccaccaagggctacattgtggctgaaaactcaggaggacacttacaaacagcagctcctgatgcacatggcctggtggggttctagaaatgaagtctactctgacaatcaaagaccaaacccactctgaggccccctgcaccagtggtgagggatctgggtcggcttggccaggatgcaggcatgaccacacggggctctgcaagcacacaggctcagggcctctgctcttcaggacaaccctggtgccttcgtcacctgcagccatctcccaggtggtaggcaccgcgtgagtctagcacagacatgttttgcagactggtgggggccagacaggcctcattctccagggactatactccacagtgccatgaaccaggcaccgagtccagagcaggagaacaggcctgtccttctggagttctgggctgtgatggtgatggcacggagttccctgaatatgacgcaaggcaaatcccaggacagcagcaggcccgtgctcaggattcctgggctggtggcagcgatccccacacaggggcagatgtcactctgatcaaggacaatagcctgctccagcatccaggcagcccaaaggaggacttgttgtcagccccctgcaggccttccctgtcccaccatgccctgtccctcccactccccatgggaaacagagaagcccctcacgcacctgcccctgtctgctgcttcctggcctacctccggcctggtgtctcagccccatcacctccacaagaccacgggggcgatgtcagaacccagccctgggctaaccctcgggggctgcccctccctgctctgctgccagctgcccagcacccagccccactgtccttcaccacactcagaggcaggccctccagggccgcagcacgtggggtctcccccaccaggactgccaggccctcttattcctccgccacctcctgcttacccagcagctgcaccagcgtgtgaagcagggccctgtgagctgggtaacctcaggatgaggctctgccacccatgcaggaggatggtgcgacagccacaggaggccaagttgtagaggggctgtggtgactgggacctgggcccatgggatagaggcagaagctcatctgaggaggggcctgggctcaatgcggacccctggccagggcgagctctgctgaaggcacaggctgacactgcaatggggacacagccatcgccatacgttcactaggctcttcccagcaggcacctggccagacagcacagcagtcacggagggtagggtcacactgtctcgggatgggctaaggcctcatgaaccatgggggcacccagaaacctgcccttgtgctaagcacaggctagaacagtggggtctgaataccaatggggacaggccacctctgtggacccttcctgctggggtacagtctggacaagtaatccccaagtgatgcgtagggtacagaacacacacgtgagctcggggccctgagggaggagactgcaggggtagaaaccacaggagacactgcaggggggaccaggtggggagatggccctcactaccacgcccacttcagaaacgcagaagcacactgctgtgggacagcactatacacccaagccctgcgccccgcccctggccactcagccaccatcttgccagccacatagccgtatgtggcacaacatcaggggctgggtcctcttgggaagagtcaggtgcattgtcataacctagtgaagggacacacacggccagggctcagctgccggaacacccagctcctagggcctccaccggcaccgtgtgtgacctgccatgctcatggcacacggcccaggcaggatgggcagtgggcagggaggccctccttgggaccactgcctgcatccctgagcctgtacttcatcccattcccctcctctcagcaaatgccctcacccctgcccagtttcccaagccacgacccagtgcccttgtgaaggccctcccaccaacttgcgcctgggctcacctcagatgtcaccagccctggagctctggcctcctcacctggcacctcctggctccagcttggagcatgaagggtccagtggagatggtggagatgcagaggcagacctgcctgcctccctgtgacaaggggctggacctgcacaccctgcccttgctgcggaccctttgctggccccttctggttcccccaccccattctgcccctcagtgggggacaccagagcctccatcagagagttcctgactcccccgaaggccatacctggctcctgcaccttggagacccacctgaggagctggcgcccctggggcagcgtctgcagccaggtcacacactggccgccgtggccatccagggtggtaaccgctctccgcgtctgcaggctccagatgtgtaccaggccactctgagacctgtttcagacaagccgagcagggtgtcagggggcagaagggtgtgctgaatgctctggggccagcctggaggccacattgtgggatgcgggcatctaggctggttgagctgaaaagccaacagctctaaatatgaactaagggccaaactggcaaagcactccttgctcctcttccagagaggggaccgggggaccctcaggagcctctaggggtaactcaggcagatctgcttctctggaggtagggggagccatgccacagtaatgcacgctgggtggtcgtgcctgctcctgcgtctgtaacaaagagtgtgtgtgtgtgtccctgcctcccccaagggacagtgtgtctgctggtgggtgctgaaagctcagcaagcctgggtggcgagcagtccatgccccttggccagcaccctcaaacaagcgctgggctccttgctagctcacgacctcctgacttggccctgggtggcctggggctggggccacagctactcaccctgagaagaggagcgggcgcccctgagcctgggctccttcgcagaagtgcagcgcatgcaccggtgactgggtgcctcggaggacaaactgggggtctggaggtggcggcgggcagggggccgtcatgctgggcaggatgcagttacctgggcaccaagggagggcgtgtgagtgactgcgtccctattctcaccctctaggaaggctgctcaggcacaggggtgcttgagatgttgcccctgctcattgtctctggccctgtgcccctcctgggagagaggtgccactgctccccagacactgatgaacggcctgtggctacagaggcaccagttccctgcacggcggtgagcccagcagagagcacagagctcacccttcccccactgctgggggaactgggagccccatggatgccagccctcctcgcaccgtgcctgttggcctctgcacctgactggtgcacccgcttgggccccacctgagccatccctgagtgggcacagcggcatccaacacttcctcggccactctggcctccagggcttcctgtccaccactggctgtgccctctggctccccagatcccaggggccacaccagtgctttcccactctggccatctgcatgccgggactgccggtcctgccactgggcttggctgagtcccgccctctgtccagggctcactccagtgtctctcttgggagccaccctccctccctgctggcaaatccagtctcccttcttctctcctccctgctgccacctctgcccatggccagctcagggatcaggggaaaagaggcacacagggtcccggggggctgctaggaggagccttcctctcacatctgctgggccccaggcctgccccgccacaatttctaaccgctatcaccaccctataaggcggcagcacccttttcactcttggggaaaccgaggcagagaatagtcactgagctgcaccaggcccctggcgctgaggcctgaagtactctagggcctcatggcaccactgaagggcagagtggctggggcagagtcgccgtgcggctccttaggagagctgcggtcacagatgagcagctgttccccagaccactgggcctgtgggggaagactgccgggccaccacccacccagagaggcttcccgggtccgtgccgagcccttccaaccactcagacccacagggcctcgcactccacctcagccccacagctggctgctctgtggggtggccctggagccagaagcgaccagctccatgtctgtctgcctgcagaccctgagctgggctaagggctcagagggaaaggccaggagcagaccactgggtggctggggcagcctgtcacagggggcctttcccactgggctctgggacagtggggcaggccccggcccagccacctgcagcctgcacacaaggcagggaggatggcccacggcagccacagccagcagagggactggggccagtaaaggaccagggcaggggagatgggaaggactcttcagaaggggctgggtggtaggcggatgggggtgcaggttcagaggcaggagtgctgtggatgtctggaggcagctgtccagggtgccccttcagcagcactgccaccgccaagccctgcctctccccttctgaatacacgccagccctctccttactctattcagagctggggcaaaggttcaaaacacctgagaaatgcccctgccaaggtgtcctgcagagtggagggtggacagcagccagtgcccaagcgggcggcatgggggagggcaggaggcctgggaggggccgggcagtgactccagggcgcaggtccaccctgcctggcgagagacctcgggcagccactctacctcccaaccctgcctctctcaaggggttccgaagacaatgcggagttccctgggatatcctttactaactgccaagtcccatttttccttttcttttttgagggggatgagagaggtttcgtcctctctcacctttggctgaaagccaactgatcatgcccaaacttaagggtggcttccaggggaggcagagggaccagaccccacactgctcccaagacccacggcccctgctccagcctgtgatggggaagactccaagactcctgaagacgcagccaggccgggggctggaacagctgccctcagcgggctggcttggaggacagttctcagaagccactgcctgtttgtgctatgcctgccaggtaagaaaggcaagctagccagggggacaggaaggcagggcccagctccaagaggagccaaagaatgcagacccggcaaaagcacctccacctagcaggaaagcaccgagtccaggatggagggtccctcccatgactccagtccaggaagcagagcctgacaggtcacctctacacaggctcccctgtgcagtccaggcacgaacacacattagacacacgctatgctcacacatacacacacatgcacatggtgcacacagacacatgcaaaacccacacataggacacatgcctacacatacatgttcacacacccatatgtgcacacacacacatgcacacacacaggcacacactcatacctacatacacatacacacacgcagactcagacactcaggcacaggcactcacgtatgtgcacacacagcacagagaagcacacacacagacagcacggcggccttgggcggtgccagccgaagcccggcccccacatgccacctgcctggggcctggcgggagtttccagaacctcaccagcagaaggctcattctcaggtgatgaaatcaagttctcctctattgtttccccagaactgcagggaacaaacccgtcacgttgttacaacaaccaaaatgcacaggccaaaatgatgcatcggcaattaagggctccatcatttcaagtaattaaaataaatgctttatttgaaaactaattaattctagctacatatttttcccatgacaatatcctaggattgcttgatttatgacatctaattattctttattaatctaattgagaatcatcacattcccctatcttgcctggccccaggctgtggagcaaaggccgcccttgcgcaaggcccgtgtgcgcccagctgtccttgcggtggccccggcccagccccggccctgtcctcccggaggcaaaggaacaggaaacttaatccacagagcacaactttggcttctgcctgctcttccaggtgtcaaagtgagccacattctttgaaaaatgaaaggcagtctgacacaatttgtgcaactctaacagcccttccagagaagccacaaacacccctgaaagccccagggaacaaatggacgacaacagcatctgcctgcaatgcaccaccgcggaggcagctcggcaggccccagggctctcccaagaggggtccagagcgctcctctgggtgtggggaccagcgggtaggtgcaactggcagagaggtccacagacaccccactcaagggaggcaggggcaggcctgcaaatgtcctgctggcgcaaacccacccacacctgcagggccttcctccctacagatgaagcagggctgcggcagtggctggagcccaaacaccacaggtccctacccaagacattcttgggctcctgggggttcatgccagacaggcctcagctcagcctgggcccccgccctgccctcgggctgcacagccctgtgctcagtcccctagcccttttgtggaaatcagcaaagagtaccacgaagtgagccaacgtggggagccaccacccagagaggccactggcaccacccctgcccaccccagcccaccaggtcctccctgtcccattgggcatgtgacagcacaaggacaggccgcacaggccgctgggagtgcctcaaacaggaccctctgccccactgcatatctcacacaagggcatggaactagctccagcatcccccgaggaagctccagcccataatcagcaagactgaagactaggtcagcacccctttacaccaggacggacaccctgggtggccctctcccaaaaaacaactaaagatgttgataaaagtttcttagaaggccaggcatggtggctcatgcctataatctcagcactttgggaggccgaggtgggaggattgcttgagcccaggagttcaagaccagcctgggcaacatagggagaccttgcctttacaaaaaataaaaataaattagccaggtgtggtggtgtatgcctgtggtcccagctactcaggaggctgaggtgggaggatagcttgagcccaggaggtcaaggctgcagtgagccatgatcgcgccactgcactccagcctgggggacagagcaagaccgcatctcaaataaattaaataaaataaataactatctttaaaaaatttttttaaacacagccaggcacagtggctcaggcctgtaatccctgcactttgggaggccaaggcaggaggattgctggagtccagaagttcaagaccagccagggcaacatagtcagacccccatctctacaaaaaaaataaataaattagctgggcatggtggtgggtgcctgtaagtccagctactcaggaggctgaggtgggagaatcatttgagcccaagagttccaggctacagtgagccacaatcacaccacggcactccagcctggacagcagaacaagaccctgtctctgaaaaaaatcaaaatcaaaatcaaaatattaaacgcatcactaagttgacaaaaaaaagtctgagctgccagaggccaaacactaagtaaaagtgcagcctcgggagacctgccaagcctgccttgagggcatttgctgcactagtgacctggatttccagctctgatggcctctggggtgacaaaaggcaaagcttagggccatcctatggtggctaacctcctaggagaaccccagtagctagatgctcagtgttaggctgagccagcactaaacctacacccacggatgccagaaaaacaccagtcctcaggtttcagccctaactcacaccaccttgagagatcccccacacttcagtctgtcttctcagaaggaacccacctgcaacccaggcctcaaggaattcactttagaataagtcctaagaagtgcaaggttgtagtcaaaaatcacaaaagtcaacaaggcactgtaatcgagagtcatgagaggcaacaaaaaacagaactagacccacagagcagagcactcgggtatataaggcaagggtgcttaacgctcttaaagaaacagagagggaactgcaactacaagtagagagcaagggagatgaaacatcatcacacagatccaaaaaaggatccaacttggtgagaggtggttgggaaacaggagatgtgtgttgcgccaaggtattactctccaaactgtttactgatcacaaaaggaaaatgtgtatcttcaatggagacatctggctgtcaccactttcaccactgagaaaagctagcactgccaataatgaacaaactggcattgcttatctcctgatgtgatgccacagacatggcaccaaccttgtgtgtccctgccaacaatgctcaacctcaatccagccataaaggaaacaatcagacacatccaggttacgagacactgggcaagactactagcttggactcatcaaaaaggtcagcatcaagagaaacaaccaaaggaaaacgctgggtaacttccacattaagagaccaaaggggcatgatgaccaaacatgacatataaaccttagatcctggctcttagatcagatcctggatcaaaaaaaagggggctataagggacatctgggggatctttgtgggtaatctgaatatggactacagataatggggtgttattaatttccttggaaggataacagtattttatgtagaagaatgtctttattcctacgagatacatccgaaagtatttaggggtgaaatgctataatgtctacaatctgctttcaaatgtttcaaaaaaaattctctcttaatctctacctatctatgtatgaatatataggcagagaagtagtacaaatgtggcaaaatgctaacaactggtgaccacaggtgaaggtgtacaggtatttattttactacacttgcagcttttctgtagatttaaaaccataaaagcatgccagaggggtggagaaagacaagtccacactggactcgtatccagaatatctaaagaacacagaggtcaacagaatacaaaagcaaacaccgaaagaaaaataagcaaaaggcttggacagatatttcacaagcaacgtaaatgtccaataaatatatgcaaagatgtttaacctaattaataatcctgggaatgcctgtcaaaactacaatgtgatataattacactctcagcagattagcaaaaaattaaacagtctgtcaaatgttgatgaagacagaggacaactggaaccttctaccatgctagaaggagcgcacacggaaacgaccactttggaaaacaatctgactccatcttgcacaccgtatgactcggcaaccctactcttagataaacaccctgaagaaattctcacaagtgtgtacaaagaaactcacacaagaatgttcctagtagtattgggtataataacaaaaaccaaaaacaacccaaatggctagcaactgcagaaaggaacacattgggtaaattcgtacgatagaatactccacagaactgaaaatgaatcaactccagtcttacatggatgaagctcaaagtcataattctcatcaagagacatgaagggagtcaaaactgaagacacagacagaaataaaatgttcacaacacgtatctgttcaaggattcattctcagaatttactccttgactcagaatatgtcactcaataagaaaaagagtgtaacacaaagtaattccaaaacgctaaaattagagatgggcaaaaaggtatatggggcaaacagaaacaataagaaagtaggggttgaaatactaatagcagacaaagttgaattccagccaaaaagcattagacttgacaaagacagatagtttttaattcttcattgcagtttacaaaatataacagtttattgccaggtgtggtgggctcacacctgtagtcccaacactttgggaggctgaggtggaaggattacttgaggccaggagtttgagaccagcctgagcaacatagtcagattccatctctcaaaacaaataaaaattcgctgggcacagttgtatagtcccagctatttgggatgctgaagaaggagaactgcttgagcccaggagtttgaggctgcagtgagccatgatcacaccactgcattaaagcctgggtgacagagtgagaccctatctaaaaaaaaaactatatatataacagtttttaatatctatatataatatataattaatctatgtaacagtttttaatatctatgcactatataacagagataccacctctatagagcagaaacgacaggagatgcagagtcacagaaagaagcctactagtgattggagaatatgacatactactctttttcttttttttttttttgagacagaatcttgctctgtcacccaggctggagtgcagtgacgtggtttcggctcactgcaacatctgcctctggggttcaagcagttcttgtgcctcagcctcccgagtagctgggactacaggcacacgccacagtgcccggctaatttctgtatttttaatagagatggggtttcaccccattggccaggctggtcttgaactcctgacctcaggtgatctgcccatcttggcctcccaaagtgctgggattacaggcatgagccaccgtgcccggccataacatactactcttagtacaagtcagatcacgtggacaataagtaggcagatagaagatccaaaaaatacaaccaacaaggtagatactacagatctataatggaactttacactctcataacagagcctacctcttcttctcaagggtacatgggacatgtataaaaattgactgtatattgggtcacaaagaaatatcagtaagtttcataaagaagaaatatttataaataaaattccatgaccacagtgcaattaaattagaaattaataaaataaaaaacaaaaaggtcttatcaaatagaaatttaaaaacaacttttaggtgaaatgggataactgaaaccacaaaaatttttttaaaatgaaaaatactacgtaccaatttatgagatatatttaaagctctgatcagaagaaaagtatagaccaataccagttatgactatcacacaaaaatagtaagtaaaatattagtaaacaagacccaatatcacattaatatacagtgatcaagtggaatttatcctagaaatgcaaggttggttcaaatagggaatttatgaaagccatatactgtattaatagatataatgagaaaaagcatgtaattatctccacagatgctgaaaaagcctttgacaatattcaatgcccattttttattaaaatacgtaaacaaacagacattgatgcatttcttagaggttaaatatatatatatatatacatcccccttggtcctaaatccaacatattattttatgaagaaatattggggacattcccactaagatcagaatgcctgctatctctactaccattcgacattgtagtggcagtataagccaaggcaattagtcaagaaaaattaagtagaggtttataattggaaaagaagacattaaactatcttcctgttgagtatagtggtacacgcctgtagtcccagctacttgggaggctgaggcaggaggattgcttgagctcaggagtttgaggctacagtgtactatgatcacacctgtgactagccattgcactccagcctcggcaacacagcaagaccccatctctagaaaaagaaaacaaaaccatattccagattatacgatggtatacatggaaagccatagaaaatcaatgataaaacagattcaaataataaaaaaaaaacttcaactggtagcaggatgtaaaactaacatagagaattcaatagtctctatgttatttgtatacaataacaataaagagcacatattacttgtacaaaaataataaccagttagagaaaattccatttataccaaagaagataaaatacttaagaataactttaataaataaatatgaaaaacctacatgaagaaaatgttaaaattctcttggaagacacaaaagtagatttgaacaaaggaaaaaggatcctttgttcttggttaagacaattcaacatcaacataaagatgtctcttctccccaaattaatttataaatttaacacaaccccaacggaaacaccagcaagcttctttatggagttagagaagttgatattaacactcacttggataaacaaaaatgtagcatgcacagaaaaacatggggaaaaattagctgcaaaggagctagccctatcagatactaacaggtactcaagtctttaggattaaaagtatagtactcctgtatagacagatggatcagtgaaatagaaagcctagaaataaacccaagtacgtgtggaagtttaatacataaaagaggtggtatctcacatcactggaacaaaaatggttaaccatataaaatcagatccatatcttacagtgaaatacacgagcataaactccaagtggatctgggatccatatgtaaaaaataaaccaagcactagaagaaaacatggaagaactgcattattaacatggttgtggaaaaggtttgtcatgactcaaaatttagatacaacgcctgtaatcccagcactttgggaggccgagacttgaggtcaggagttcaaaaccagcctggccaacatggtaaaaccccatctctactaaaaatacaaaattatctgggcgcggtggcaagcacctgtaatctttgtacagctactcgggaggctgaggcaggagaaatgctttaacccaggaggcgaaagttgcagtgggcccagatcatgccattgcactccagtctgggtgagaaagtaagactctatctaaaaaaaaaaaaaaacaataaaataaaatggataattctgactatagaaaaataaaaatttttcatgcctgtaatcccagcactttgggaggctgaggcgggaggatcacaaggtcaggagatcgagatcaccctgactaacacggtgaaaccccatctctactaaaaatacaaaaaattagctgggtgtggtggcaggtgcctgtagtcccagttacttgggaggctgaggtaggagaatggcgtgaacccgggaggcggagcttgtagtgagccaagatcacaccactgcactccagcctgggcgacagagtgagactctgcctcaaaaaaaaaaataaaagaaataaaaagaaagacaaaaattttagcatttgcatgtcaaaagaaatttaaaaattaatatctttaaaatataaataaacttttcaatattaaggaaagcctaaaaactcaatagaaaaatgggaaaaagagatgaatagacaattcagaaaaagctatgaaaatgcccattaaacacatgaaaagatgttcaaccaaaagcttactcatagaaaaatgtaaattaaaactacagaaaagcttcttgttctggcaggatgaagtaagctcattacagcctctctctcaggctgactgcaactcaaaactctggacaaaatataaaaagcaactacctaaggctgggcacagtggctaacatcattaatcccagcactttgggaggctgaggtgggaggatcacttgaggccaggagttcaagaccagcctgggcaacatagtcagaccctgtctttacgaaaaataaaaaatattagctgggctgatagcgtgtgcttgcaggcctagttacttgggaggctgaggtgggaggatcacttaagcccaggagttcaaggctgcagcgagctgtgattgtgccactgcactcctctctgggcaacagagcaagattctatcccaccccccaaaaaatcccaaaaaacaattctctgaaaacagaaaagtgggcaacagcagccagccgggttttggaggaaagcaaagcttaggacagtgacctacacagagacatgtttcctaggttattcgtatgtgtgttttggggtgctgccctacagttggccctggttgcagagctaccaggcagcagtggctaaaacttggataaaactccaaatttctagatagagatacagagaaaaaggtgcgctacggccccaagaatgtgaggggaaaccctgaaggtttactgtccccctctctcacggtgctgccccagggatggccctgcacacagagcccaggggaaagtgactgagagagaagcttgtctttctgatcaggggaaccaaggaaagggaaccctgcaagatggcaaggggggaaactacagagtggggagagctaaaaaaagttccccaattctgtgaataaatacacagaagcctcaagctcacccctgagctgtgtatacacagggcagacccaaagcagcaccagctgtaagaagggaagtaaaccaacactcaagtctcaggctgagccctgggtggctgatgtgcgagacagaaccaaagcagcatgtcaaaagctctgaaaataaaaatgagattaaaaccacagcccacggagggcgagatggagcttgtgcaaatctaactgggttgactgcctgctagcgccaaactcagctctctctggaggacctcacacactattcaacccaggatatgtctaggatatcatccaaaattattcagcatacaaagaacccggaaaatgagaccaactctcaaggaaaaagccaatttacagatgccaaccttgagaagattcagatgttggaaatatctggtaaaaattttaaagcagctttatgattatgctgcatgaggcaaaaataaacatccttgaactgaatggagggaaaagacctctcagcagagaaatagaaattattttttaaaaaaccaaacaaatacgaatttcagaactgaataatatctgaaaaaaatcaataatggaatgggagatgacagagtgacataaagtgggccaggcgtggtggcttacatctgtaatctctgcactttgggaggccaagacggaggatggcttgaggagttcaaggctgcagtgagctatgatcgtgccaccgtactccagcctaggcaacagagcaagaccctgtctctaaaataaaataaaataggccggacgcggtagttcacacctgtaatcccaacactttgggaggctgaggcaggtggatcacttgaggtcaggagttcgagactagcctggccaacatggtgaaaccctgactctactaaaaaaatacaaaaattagccaggcatggtggcgggcgcctgtaatcccagttacttgggaggctgaggcaggagaattgcttgaaactgggaggcggaggttgccgtgagccgatatcataccacggcactccagccggggcgacaaagtgagactccgtctcaaagagaaaaacaataataataataatataaatataaatataaatataaaataaaagattgagtaagtgaaattattcaatataagatcagaaagaaaaaagattgaaataagtggttagcatagcagggacttgtggaataatagtaaaaggtctaacattaagggcagtggagtctgagaagtagaagagagaaacagatttggacccaaaaattaattgaataaataatgcctgaaatttcacaaacttagagaaagacaaaagcacatatgtttaagaacatgatgaaccataaacgaaccataggataaattcaaagaaaacaatattgaaacatcataaactgctgaaaaataataatgaaaccatggaggccagaagggtggaacatctttgttaaagaactgaaagaaaacaactctatatctagcaaaatattctttggggatgaaggcaaaataaagattcccagatgagggcaaatgagaatttcttgcctacagatctgcactaaaagaaatgctaaagttcttcaggttcaaaagacatgataccagaaagacatgtggaacttcaagaaggtaggaggagcaatggtaaaatgcggttttatcacttcagtaaacatgtatgattgttaaaattgtattatctgttgaggttttcaatatggcagttataacataatggaggagggtaagggacctatgtggttgtaagccttctatattttatttgaaatggaaaaatattaactctaagaagactgtgaagggttaattaagtatgtacactgtcatccctgcagcaaccattaaaaacataacacaaagagatactgccaaagttccaacaaaaaatcaaaacaatgttttaaaatacctaaataattcaagagaggacaggaaagaggggatagaagaaaaaaaaagaagagaagaaaaagagaaaacaacaaaatagtagacctaaatataaccataccaatcactacaataaacataaatgctcccaacatgctaattataagacccaactataagctataaaaaataaaaaggtgaaaaagatatgctatacaaataataaattgcagtggatatattaatatcaggcaaagtagacctcagagtgaggaatattatcacggacaagaagaagatacaatgataaatggcatcgattcagaaagaagacacaaaagttgtaaatactgagctaataagagaacttcaaaatgcatgaagaaaaaactgatggaactgaaagtagaaatagataactacataattataggtggagacttaaactcctccttagtaactgactgaacaagtggtcaggaagtcatacagaagacctgactaatactatctacctacttgacctagttgacatttatagaacatgccgctcagtagaagaaacacattcctctcaaatgcacatggagcactcatcaagataggccatatcctgggtcataaaagaaaccttaaaaatgtaaaaaaaaaaaaaaacaaacaaacaaacaaaaaaaaaacctcacgcctgtaatcccagcactttgggaggtcgaggcaggcagatcacgaggtcaggggttcaagaccagcctggccagcatggtgaaaccccacctaaaaatacaaaaaattagccaggcatagtagcgcacgcctgtagtcccagctatccaggaggctgaggcagaagaattgcttgaacccagctggcggaggttgcagtgagtcaagatcgcgccactgcactccagcctgggcgacagagcgagactctgtctcgataaaaaaaaaaatgtaaaaaaacaaagtatacaaagtatgctctctgatcatatggaattaaactggaaatcaataacagcaagataatgaaaatctccaactatttggaaattaaacaacactgttttatataatcaatgggttcaagaggaagtcccaagggaaattagaaaatatctaaactaaatacaaatgaaaacaccacatatcaaaacgtgtaggatgcagctaaaacagtgcttagagggaaatttacagcattaaatacttacatcgacaagaagaaaggtctccaaatcaatgacctggtttatgccttaagataacagaaaaagaggacaaagtaagcccaaaacaagcacaaggaaggaaataagattagagcagaaataaatatttttaaagaatagtaaaacaaatgagaaaataaagcaagaggtcggttctttaaaaagatcaataaaactgataaatctctagctgaactgacaacaataaaaagagaagagacaaattataataattaaagaagggttatcactacagacaccagaaacattaaaaggataaggagatactatgaacaactcaaataaattcaagctaaataaacctagctgaaatgaaagttggaagacacagactatgtgaagaaagagaagacctgaatagtcctgtatcaattaaaggaatcacatttttagtttaaatccttggggaaaaaaaaaaatcaaaattccagcccacatgactttactggcaaattctaccaaacatttaaagaagaaataacactattctacaaattattttcccagaaaacagaaaaagagagaacatttcccaactaatttgatgaggctagcactaacccaataccaaaaccagacaaagttagtagaaagagaagaaaaccacaaacaaacatatttcatgaatatagacatacaaatcctcaaacaaaataatatcttgctgcttaagtctcaagttggggagggaaaaacagcaaatctaatccaacagtgtagaaaaagaatacactggagccaactggcatttatctcaggaatgcaaagctgattcaatattcaaaaatcattcaatgtaaactctcatgttaacactaaagaaaaaccacaggatcatataagttaatatagaaaaggcactgggcagaattcaacatccattcatgatttttaaaaaaaccctcagaaagcataatccataagataaaaaacacaaattcaccttccacaaaattagaaacctttgctcttgaaaagagattttttttttttttttgagatggagtctcgctctgttgcccagactggagtgcagtggcgcgatctcggctcactgcaagctctgcctcctgggttcacgccattctcccacctcagcctcctgagtagctgggactacaggcgcccaccaccacacccggctaattttttgtatttttagtagagacggggtctcaccgtgttagccaggatggtgttgatctcctgacctcgtgatccacccgcctcggcctcccaaagtgctgggattacaggcgtgagccaccacgcccggcctgaaaagagattattaagaaaatgaaaagacaatctatacagatggggaaaaatattttcaaatgatgtatatggcagataatttatataccaaatatataattttcaaaatccacaaggaaaacacactcacaaaataaaaccactaagaatgggcaatagatttgaacaaacacttcaccaaagaagatatgcaaatggcaaataaggacatgaaaacatactcaacatctttagtcgctaggaaaatgtaaattaaaaccacaataaaatgccattacctacttatcagaatggctaaaacagaaaagactgaccattccagttgctggaaagcttatgaagtaattgaaactctcatacgctgctgatgggattataaaatggtacaaccccttgggaacaaagtttggctatttctttaaaaaccagtcacatactggagacaacccaaatgcccatcaacagcagaagaaacagagctatatccacacctggatatatccatccttgacaatgacaaagtaggaagtactgatacatgctttaatgtgaataaatctcaaaataatcatgtcaggtgaaagaagccagaaaaagagagtaaattctgtgattctatttatgcaaaattctaggagatacaaactgacctacagtgacagaaagcagattaaagggaacctggagaagagaggtgcagggaggaagaagggaggggcatgcagagacgcaggaagatactttaggcacagtgggtatgttggttgtcttgagcgtggggatggcgtcacagacgccgcacttgtcaaactgtccacttgaaatatgtgcagtttattgcatacgcaatttaattgcacaatctatttttgtgctcattaaaggaaatgcaagagcaactaaacaatccaattaaaaaggcataaaagatttggccaaacactccacctaaaaagatgtgcaaataagcacaaaaggcaactcaacatcatagccattagggaaatgcaacttatgcccataatgaaataccactacatacctactagagtggctaaaattcagaaaaaaactgtcaaaaccaacaaaaccaagtgctggcaatactgtggggcaactggaaccttgttggtgaaatgcaaaatggtgcccacactctggaaaagagtatggcagtttcttatttatttatttttttatttttatttttattttttttttgagacagagtctcgctctgttgccaggatggagtgcagtggcacaatctcagctcactgcaacctccgcctcccaggttcaagcgattctcctgtctcagcctcctgggtagctggattacagacgcctgccaccgcgcccggctaatttttgtagagacagggtttcaccatgttggccaggatggtcttgatctcctgacctcatgatccacccgccttggcctcccaaagtgctgggattacaggcatgaaccactgtgcccagcccagtttcttataaaattaaatatgcattaacatgttgcccaacaattctactcctagatatgtattctagagaagtgaaaacttatatgcaaacaaaaacctgtacatgaatgtttatagtagttataactaaccacccaaaacagaaatgtgaaaactataatctcctaaaacagaaaataacccaaatgaccatctatggatgaatggaatactattctgcaacagaaaggaacaaactattgataaatgcaacaacgtgggtgaatctccaaagaactgagtaaaaggctacacactatttatatggcatcctggaaaaggcaaaagtataggtacagaggacagaccagtgactgtcatggatcagaaggagggggaggggatcactgccaaagggcagcaaaaggcagggttttgagagaatgagaagttttctgtgtcctgattgaggtggtgttgacacagacatgggttaggactcactgtaagcgcacacaataataaagataataacaataatacagtagttccaccttatctaggggggatgatgaatgatgatgatgaaaagtatctagggatacttttcaagacccccagtggatgcctaaaaccatgaatagttctgaaccctatatacaccatgtttttccctacagtgtacatatatacctacgggaaagtttaatttaaaaattagagacaggcacagtggttcatgcctctaatcccagtactttgggaggccaaggcaggaggatcactgagcccaggagttcaagaccagcctgggcaacacagggagaccctgtctctacaaaaaataattagctggggcagggcacaatggctcacacctgtaatcccagcactttgggaggctgaggcaagcggatcacctgaggtcaggagttcaagaccagcctggctaacatggtgaaactctgtctctactaaaattacaaaaattagcccaggcgtggtggcaggtgcctgtaatcccacctgctcaggaggctgagacaggagaatcacctgaacccaggaggtggaggttgcagtgagccaagatcgtaccactgcactccagcctgggcaacagagactccgtctcaataataataataataacaataataataataataataataagccaggtgtgttggcacatgtctgtagtcccagctactcaagaggttgaggtggtaggatcacttgagcccgtggagtttgagactgcagtgagctatgctcacaccactgcacttcagcctaggcaacacagcaagatcttgcctcaaaaaaaaaaaaagtatactatgataaaagttatgtgaatgtggtctctctcttacaatatcctgttgtattgtactcacctattttcagactgcaattgaccatgggtaactgaaacctcagcaaaagtgtagatgagaggggagctagtgtcgtaataaaatgcccatgagtccacactgaggtaaagaaatgactaaataaacaaatctcccaaacagaagaattccactttatgcagacactctaccatcaaggaggagtagataactcccaaccgtttaaatatgggttatgcagtgactcccttcctaagaggagagtacggaaaggagagaaaaacagccactttacagcagaaacacctgacagataccacctccgccaggtgatgacgctcagcatcagcagggctaggtcatgctgaccacacgtcccactgacatgatagaaaatccaggaatgggccaggtgcatggctcacacctgtaatcccagcactttgggaggtcgaggcgggtggatcacttgaggtcaggagttcgaggccagcctggccaacatggtgaaatgccgaccctactaaaaatacaaaaattagccaggcatggtggcacgtgcctgtaatcccagctactggggaggctgaggcaggagaatcgcttgaacccgacaggcagagattgcagtgagccgagatcgtgccattgcactccagcctaggcgaagaagcgaaactccgtctcaaaaaaaaaaaaagaaagaaagaaaaagaaaatccatccaggaatggcattcaacctttgtgcttttcttcccaaaacccttaagctcagtctaatcgtgagaagaacacaacaaatcccggtggaggaacattttacaagagcctgaccagtgctcctcaaaacttaaggttatcaacaacaagaaaagtctaagaagttgtcctggccagaggagcctggggagacaggagagcaaacgcagtgtggggttctggatgggattctgcaacagaaaaggacattagggcaaattcaggaaccctggatgaagcctggactttggtcactaacaatgcatcaatcctagtccattagtcatgcgcagagcaagatgctgacaggaaaaagggctcagaaatgcgtccgtgcacaaggttcacactcaaccactgctcttggccacagtctcacaggttatgtttcaaataaaatatattgtacaagattcttgtgctattttttcttgtgttacagttaatggtatttaatttacactaatgtattatgaaacttcaattcctgtttctggctttggagtcaatttctatctctactcaaggtgacttaaacagacttaatgagcctgggcaacatagcaagacccccatctctacaaacaaataatttaaaaaaatcggccagttatggtggtgcccgccatgatagtcccagctatgttggtggctgaagcaggaggagaggatcacttgagcccaggaggttaaggctgcagtgagctatgatcacactactgcactgcagcctagcctaaagagacctgcctctaaaataaacaaacaaaacagacttaatgtcaacttttacacgcttttcccattccaaataatttactatcttatttttgccctaatataaattcatcaacagtgccccctggtacaagctagtagttattcggttaagcaaatgagctgatgacttttatgaccatcgttacttccagaaggtgtccccagccagctggggacagaaagagcactgatctaaccactgttgcgcttcaccagcccagcccacctaatttctctatgaagtagcacagccgttctagcatgaagatgttgaattggctggtcctccaggccagcaagaacatgaagccaaggccatgaggcctgaggcaggcacacaggtggctggtgaatgggctccctcccacctcctgctcatcaggcacctcccaggctacacctggaaccagaaaggcactccctggacaggcctgtcctgagcagagacctcagtgtcatcccctgccttcctggtgaggaagacagcagcagtaaggcccagaatctcagaactgtccgctgcattgcagcctcagccagcgaccctgatctcccaaaaagcctcacacacaccactccaagaagctgcatcagacacagagccctgggctatcccagtcagttcactggcacacatctcagtgctgctgcttcaaaccaggaaactgaggtctagatacacccttccccatctctgaaatgcagggagatcagcggggagtcagtgggggcagtcagagactagcccccaacaacccttctcagtcactgatgtctgcccaccaaggcctcgggggccaggattgcttccatggccttggctctcagcccaggacgggggtgggagcagcctggtgagtaatgcccaggcccccaagaggtggtcctgccataaataatgccaaggacacatcccccttcaagggaggccagacctgccagggagggctgcagaaaagctgcactctagctgcaaacaggaagggatgagcctgctcagatggtgaggtccctatcctgttacctgccactcacggccacaaaggaccagaaaccctccctgggcaaggaaaacatgctgcacctccctgtttggacccacggctaccagggccagctactggagataccaggactctgctagtgtcacctggcctgggaaggacctaagcagctcaagctggccacacagcagccacagccctggccatggcccccacctgcccactcccactgcagccagctccctgtcctgagcacgggaaacaggtctaccagcactaactcaaacttcacaaagaaaccatttctggaatggggctccgtttggcgattcggagtcaaaggcgcacttcatagctcctttccaaatcccgtgcattgtcaggccctgttcccctttgaagcctcgctgagtgattgaagcgtctactttctgaggggcagatagcaccgggctggtaatctgactctaagccacgggataaaggtagtttgtttcctctcagcccgtctgtcaacacctcctcagtaattagccctaattattacagagggccagcctcccattcggttattaaatcagaaatagtatcacggctgggcatctgtcaacgccccgactggcgaccttcgattcattgaatcctctgtcagtatccgcctttggaagcgcccaggcgggcagggaggcagcggcttcaaagatgcagatcccaggaagaattccggtgaggcagggaggcagggagggccggtgcccagcagcccgatggcgagggggagccaggcaccgccccccgggcagcaagtgcacagcccaaccccagcaatttcccacctcccagggctgaccgatgtcagtctctctgtggcggggaataaggtatgccccccaagaactccttcccttggagaagaaagcacctccaggcctgcatcaggcatatccgtctcagggagtggccctgactgacaacttggcctgaggcccacaaagccctgaaccagctcagtgcagggaggggaacccgagccccggctgcccagagcactggtaagctggcaaatctgcaaagcagaactcagattccagccatagacacgatttccatagtggagatgagagtgctacagtcctgtaggccccgacgaaggacagccacccatctcccttctgggtctgagtctgttctccatcctagagaaatggtcatttgctctgccacaggggccttctgctctggcaaagcacctccaccctgctcccctagggtatagctgccccccagcaagattcactgcctcaggccaggggccggcactgacctcacctcacctggggcagtggcccaggtgccccagggctggccaccagcacttctccagagactgagacccacagtgccccacccaggactcctggcctgcagtgagccaggtggggcccagcacggtgcctacatgctgaaccccaccaggtctgtgccgcccccttccagataggccctgctgcgtgtgagggagggtcccagagatcagtcacttttgctggggacacgcccaaatggcgtgattcgttcccgagcagagacaagcaagttcctctagacagcccactgcagcctgttctcccccgaggcactgccagtccctgctgggtgctctgccagcactttgggtcctcgtggccaccaaccacccaccacgctggcagggggagtgggtctcatggagacaaggacatggattagttttcttccttggggatgcctggaagcctcatggctggggcatgaggagtgacctgctggccagctccacagtcagcaggggcgccaggcaggcgctgaggctgcaagtcagacttctcctttgcactgggacacgggctgcctcagctgagccaagaggaaatgccagcgtgaggagccaccaggctgcagaggcaggcaggatgggcaggcggggtctctctgtgagcaggcatctcacgctgtggctggggatgtccgtcgccccaggagcgggtcccaggagcctggcaagatggcaggaaggaagcctgacttggacattgttagccagcctgccccaggcacttacgggcagaggcaggaacccagccagcagagggaccggcctttttgacccgggtgaacacacggaaaagctcactgctttacaggaagcgtgacatccccgtgcaccagttcagcctctgctcagaggcctggttcatgtaggccagctgccgatcccatcagggagagacaacactcacagagggtgcaggatggggaccaatcccctggggctggtgcccctggcctcggggatggggatgtgccctggaaacttggtcggagctggaggaggggtccctaagcaagctggggctgacactttctgacagggacttgcctgtgtggctcctcctgtggcggaggcaaccttgggtggaaaggggaggtcccctatcacacacaggtggtggtgtggccaggtgtatgtctcatcaactcccgaccacccagctgcatgcagtcagctgtgcacatgcttacatatgcatgccagcaatgtgcttgcccacatccacagacatgcgaatgaggacagaggccagcctcccactcgctctgccctgtgggtgctgcaggtggacccctcactgagggccccccctatgcacagcctgtgaataaagagccctggctccacaacccacaaacactccccagtcccctgcagtgctcagacacagaggtgaggtgggcagcgcaggcacagcagggggcaggggagtcagatgtcctgtgcacccagctggcagccccaccaatggggacacagaagaatgtggcaagtgcatgagcacccatcatccacaggccccagccctgtgctgggggtggttcctgaggccaggaggaaaggagccggccaatgagaacaccccacaggcctgggctcttccttggccagcccctacccaccgtgtccctgtaatagagatgatgtagcccaaagaaaaactaagggagcaacgggccctgctgtcctggagagcaggcttggccaggctgtccagcgacaaggcacccccgaggcctgcaccaggagagtgtgaacactgctggggctgggcaagggccatgacaccatcctcgctgcctctgcatttgtgatccaatgtgttttaaaacttgcaaagacaacttgaaaaatggggacatggatggtttccctatgacataagcaagacttaaaagctagaataactagtaagggacagatcagaccagagagcaggcgggtaggccaggcatggctcacgggtggctgcagccagactgtgagttgctgcagccagcagctgatgctgaggtaggccctatggaaaaaggtgaaatgggatcccctgttggtcaggacataataggttatgctgtggaaaacacaagccccaaactcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctcctaggagcgccgcgcagcgtccagagaccgattacatcgcgcagccacgcccccagcgtgcgcgcggccgccgtgtacgacccggcgcatgctcccggcacgctccacgcgctcctcccatccaggccgcgcctgcgctgtatgccgtgtggccgctacctcgcaggctctcccggtccctgctggcgcggcagtgccgcgcggtgggtgatgggagagcgcgcccattcccacgccgcgccaagtgccacgggatcaggtggggccgcgtgtacaggcgcgagacggtcgggccaaagctgcccctcatgatccccagcggacggtgcccggcggtccctcagatccgggaaatctgcacccggctgtggcgtagaccgaggggccgatgctgcttcagcccgccgttactgccctggcgtcagccagacactggggtgctgctgggcgtcgagagggctgctgcggggccgggctaagcctggggggctgcaggtgtcggggtggatgtgggcatagcggggctgctgggcctcgtgagcgccctggaacggcgtgcccgcggagtgcctctcatcactcattgccagtgcggggaaccttgttagggcccggttcgacgtagctgcaggctgggcgccagaggcagggggcaggcagtccgagaggaccctctacctgcatacctgggggctgcaggcagggcctctgggcctccttgttgtggatataattgtgtgcttcccgactcaggccgaggctggacccggagacgacagcgagggcaggctaccaagccctccccacagggccgtgcccagcccaagcctgccgagtcagcacccagatcctgggacaagataggtgaggatgaagtggtggtgctcttctcacttgcacaagccgtcccacgccacctctcctcggcttcacggtgcctagagaagaggtgggagagggtgcaggcgccccagctcaggatctgatgcctgtgggccaaggacctggatgcaagccaggagtccttggggccacgggcaggcagccggattcaccggaaagtgacgcttctcaaggggaacacacacgtaacacaccagctccctttctgccctggtccagtgactcctttcatgaaagctctctgaaatgttatctgcatttacacccaaactcactcactttgatccctgaaacgcgaatcaaaggtcacattgtaccttccctgggtctgtggggctttcagcagcctgggccaaaaataataaaagtggcaccgagccaggaaacgcctccttgaagtgggaatgaaatttggatttttttcggttgtatctttcctaattgacctgataatttaaacttcctccctcaagggaaaggtgggggttcccacaaattcagcttacctcagcctcaaggcagctcagtctacagctcagcgcccatcagcagagtgggcagtgggcctgtggaagaaatgaatccaactgagccagaaaaggccttttttggtccaaattttttttttctttcaggccctctcctgtgtataactgtcatgcaccgcataacaacgttttggtcaactagggaccacatatgtaactggtcatccagtaagctatagttattttattattgaagaaagaaaatttttaggccaggcgctgtggaggctcatgcttgtaatcccagcattttgggagcccaaggcgggcagctcatttgaggtcaggagtttgagaccagcctggtcaacatggtgaaaccctgtctctaccaaaaatacaaaaaattagccgggcgtggtggtatgtgcctgtaatcccagctacttgggaggctgaggcaggagaatcgcttgaacccaggaggcggaggttgcagtgagctgagattgtgctactgcactccagcctgggcaatagagtgagactccatctcaaaaaaaaaggaaaatgtttaatataagtgtgttgcagcctaagtgtacagtgtttataaagtctaaagtagtgtacaataatgtcttaggccttcacattcactcaccactcacacccacagcaacttccagtcctgcacctctgttcatggcaagtgccctaaccagttctattttttattttttgcactgtacttttactgtacctttgctatgattaggtgcactaataccactgtgtcacaattgcctacattgttcagtagagtcactgtgcaagtttgtagcccaggagcaacaggccttaccatacagcctaggtgtgtagtaggctctaccatcttagtttgtgtaagttactctatgaggatccctccatgacaaaatcgcctagtgacacatttctcagagtgtatccccacagttaagtgacatatgactgtttttttattgtggtaaaatatagtaacatttaccattttagccatttttaggtatacagttcaggagcattaagtacattcatgctgttgtatatccagtgatcactatttatttctagaactttttcttcactccagaacattaactcctcttcccctcccactcgcaacccctggtaaccatcattctatattctgtctctgtgaatttaattactctaggtacctcatataagtggaatcatacagtatttatcattttgtgactggattatttcactcaacatgttttcaaggttcatccacatcgtagcatgtgtcagaacttccttcatttttaaggctgtgtaatattcctttgtacacattgaccagattttgtttattcatttgttgattgacacttgggttgttttcaccttttggctattgtgaataatgctgctatgaacattagtgtacaagtatatgtttgagtccctgctttcagtacataagagtgaaattgctgaatgatacggtaatattttgtttgactttttgagagattgccaaacttttccatagcaagtgaaccattttacattcccaccaacagtgcacaggagttccaacttctccacatcctcaccaacacttggttaccttctcttttgtttttttccaatagccatcctaacggtatgaagtggtgtcccattgtgattttaatttgcatttctctaatgactagtgagattgagcatcttttcctgttattggccatttgtatatcttcactggagaaatggctattcaagtcctatgcccatttttcactggatttttgtttttattgttgagttgtaagatttttctagatattctggatattaatcccttgtcagatatatcatttgcaagtatttctccataggctgccttttcactctgttgatagtgtcttttgatacacagaagtttttcattttcattaaaatgtcattaacttaatttcactaaattaatttcattaatttccaagtctaatttgtctatatgttggtggtagtggtggtgttatatctaaatcattgccaaatccagtgctatgaagttttgccctatgttttctgctaagttttataggtttaggtctttatatttaggactttgacccattttgagttcatttttacatacggtgttaggtagggatccagcttcattcttttgcatttgaatatccagatgtcccagcatgatttgttgaagactatcctttccctatcttagtacccttgttgaaaatcatttgaccatatatgcaagggtttatttccaggctctctagtctgttccattggtctgtatgtctgtctttcttttttcaggaaagtacagtgttcaaactacacagtcttgattactgtggctttgttttaaattttgaaatcaggaagtgagaagcctctaagtttgttctttttcaagatggttttggctattaggagttcctacagattccatatgaattttaggatgggttttatcttcctttcttttttattttttttatttttttttttgagacagaatcttgctctgtcgcctaggctggagtgcagtggtgcaatctcggctcactgcaacctctgcctcccaggttcacgccattctcctgcctcagcctcctgagtagctgggactacaggcacccgccaccacgcctggctaattttttttatttttagtagagacagggtttcaccgtgttagccaggatggtcttgatctcttgacctcgtgatccacccatctcggcctcccaaagtgctgggattacaggcgtgagccaccgtgcccggcctttttttttttttttttaaactagacacagggtctcccctgtcacccagactagagtttagtagcctgataatagctcactgctgcctcaaattcttgggctcaagtgatcctcctgcctcaacctctaaagtacctatgactacagacatgtgctaccacacctggctttttgttgttgttgttgttaaagctagggtctcgttatattgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatttaaatgaaactgctaatttccttcatgaagtgttcactgctagtactatatagaaatgcaactgatttctgtgtgttgattttgtatttgacaactttgctgaatttgttaattattctgtttttatagaatcgctataagatcatgtcattggtgaaaaaatataattttactccctatccaatgtggatgccttttattttcttgtctaattgctctggctaggactttcagtactatcttgaatagaagtggcaaaagcgggtatctttgccctgttgctgatctttggggaaaagctttcagtcgttcaccattgagtgtgatgttggctgtgggtttttcatgtatgggctttatcatattgaggaagtgtctttctgttcctcgtttatttagtatttttatcatgaaaaggtgttgaattttgtcaagtgctttttctgtatcaattgagatgatcatgtgttttttccccttctttctaatgtggtgtattacattgatttcaatgtatacattttttcttttttctttttttattgagatagggtctcgctccatcactcagcctggacacagctcgctgcagcctcaattcctgggctcaagtgatcctaccccctcggcctcccgagcagctgggacaacaggtgtgtgccaccacattggcacttttttctttttctgtagagacagggtctccctatgttgcccaggctggtcccaaacccctgggctcaagcaatcctcccaccttggcctcccaaagtactgggattataggtgtgagccaccacacccggcttcaatgtatatatttttaaatgattttaggccatgtgtggtggcttatgcatgtaatcccagcactttgggaggctagggtgggaggattgattgaacccaggaattcgagactagactggacaacatagggagagcccatctctaaaacaaaacaaattttaaaattagctgggcatggtgttgtgcacctgtggccccagctactcaggacgctgaggcagaaggattgcttgagtccgggaggtttggggcttcagtgagctatgattgtgccactgcactccagcctgtgcaagagtgagaccctgtctcaaattaaaaaaaaaaaaatgtggaactgaatcctttcgtatccatcagaggccccagtttcattcccagaaaggagtctccttcctgccctgctggtggggctgcaccctacttgactcctttggatacttcagacaccctaccatcttagccagggcagggaggtggctgggcacccaagcctggtgaccctggggctgtttgcgcttcaccccttagaaaccagtgttctctttgtgggtttccttccattctttagttttgttttaattaaaaaacaatttttttaaaggcagggtctctgttgcccaggctgagtacagtggcacgatcatagctcactgcagccccaaactcctgggctcaagtgattctcctgcctcagcctcctgagtagtggggaccacaggtgtgtaccaccatgtctggctaactttttaaatttttgtagaggtggaactcactccattcttttttattttttttaattgaggtaagacttaagtctcaggtacgaacaacaacaaaattgaggtaagatttactacaatggaaggcacggatcttttatatttttaaaaaatgttatcaggcagcctcccaaaccagaataggtttggagagactcccagaatgcacagatcttaacagcagggtttcatgacttttgtatgtgcagaccactgccacatacgagtaagctacggaacactcctttccctgaaagcacccacaggcccgttcctcacaggcaccgttctgatttctactccatccctttattttgctcactctggaacttctcacaaatggaatgctacagtatagactcttgagtctggccttttccagtcaatacagcatttgcaagattcatcaatgttgcggtcacatgtgtctcatttgtttttttgtttttgtttttcttaagcacagtgtgatagtaaatctcatttgttctgagtgctgtgtagcatctcattgcatgactacagtttgtctgtccattctctctgtctctttaattttttgtagagatggggtcttgcttgttgccaaggccagtctcgaactcctggtctcaagtgatttgcgcgcctcggcctcccaaagtgctgggactacaagtgtgatccactgtgccaggcccctgttctcttattgatggacattcttgtgatttctggtttggaaccattatgaataaagctgctctcagcattcttgaacaagttctttttgttcacctaaggtttcattacttctgggtaaatatctaagagtggacttgctggatcatagggtaggtgcatatatttaactttatttatttgtttattttattttgagacagagtctgtagcccaagctgaagtgcagtggcacaatctcagcccactgcaacctctgccttctgggttcaagcaattctcctgccccagcctcttgagtagctgggattacaggcatctgccaccatgaccggctactttttgtatttttagtagagctgggggtttcaccatgttggccaggctggtctcgaactcctgacctcaggtgatccacccaccttggcctccctaagtgctgggattacaggcatgaaccaccacgcctggccaatacatttaactcaactttatatgaaactgccctctaggcgcagtggctcatgcctgtaatcccagcactttgggaggccaaggccgggcagttcacgaggtcaagagatcgagaccatcctggcgaacatggtgaaaccctgtctctatttaaaaatataaaaattagctgggcatcgtggcacacgcctgtagtcccagctactcgggaggctgaggcaggagaatcgcttgaacccgggaggtggaggttgcagtgagccgagatcgcaccactgcactccaacctgggtgagagagtgaaactccatctcaaaaaaaaaaaaaagaagaaactgccaagagcgtttcacagtagctgaaactcatctttcctgcagcattgtatgtgcattccagttgtcagttgttccacatcctcaccacacttgctattgtcaatcttttacattttaatcattctggcgggaatggagtggtatctcattgtagttttgatttgcattttcctggtaactaatgatgtccatgattttatgtggttgtttttcaccttctattaatttgcaagagccttggggggtgttttgttttgttttgttttgttttgttttgtttgttgtgtctcgctgtgtctcccaggctggagtgcaggggcgcaatctccagtcactgcaacctccgcctcccaggttcaggtgattctcctgcctcagtctcctgagtagcttggattacaagtgtgcgccaccacacccggctaattttttagtaaagacggggtttcaccatgttggccaggttgctctcgaactcctgacttcaagtgatccacccatctcagcctccccaaagtgctgggattacaggtgtaggccactgtgcccggccaagagtttttgcatatattctgaataaaagtctttgtcagatataaatattgcaaacactctttcctaatctgtcacttgcctactcgctttcttgatgtgcccttttgaagagcaaaacttttacatttggatgcctgtgctttttgtgccctaagaagctttgctacctgaacgttatgaaggttttcttctgtttagttttggaagttctattattttcacttctacatgcaggtctgtggtgtattttgcattgattttcatgtgtgatgtgagtcaaagtttgttttctccttatggacatcccattgttttagcaccattaattaaaaggactgtcgtcttctccattgaatcaccttggcactcttgttaaaatccaggtactacatttgtgcggatctacttccggacccctattgtgttccactgatttttgtcctcaggcccaaagcataccgtattcattattgtagctggccaggcacaatgctcacgactgtaatctttgggaggccaaggtgggagaatcacttaaggccaggaatttgagaccatcctgggcaacatagcaagactctgtctctataaacaaaatgatagctttatagtaacacttgaaattagatagtgtaagtcctccaactctgttttcctttttcaaaattgttttggccattctagttcttctgcacatacatgtaaactttgtaatcaatctgtgaatttctataaaaataatcagcctgacaattgctcatgggattttgattaagattttgttgaatctataaatttggggacatagaacatcttaaaaatatctcatctttcaatccttgaacagattacatctcttcattgatttaggtcttcattaatttcttttcttttttctttttttttttttttgagacagggtctcactctgttgcccaggccggagtgcagtagcacaatctcggcttactgcaacctccacttcacaggctcaaacgatcctcctgcctcagcctcccaagtagctgggactacaggcatgtgtcaccatgcctggctaatttttgtatttttaatagagatgggtcttaccatgttgtccaggctggtcttgaactcctggactcaagtgatctgcttgtctcggcctcccgaagtgctgggattacaggcatgagccaccgtgcccgaccttaggtcttcattaatttctttcaggaatgtttatagttggcagtgcataggtttgggcatgttttattaaatttatccctacacattttatgttttttgatgctactgtaaatggtacttttaaccaccacatgtcctcactcatatgtggaaggtaaaaaaaatgatctcacattagtcaaaagtaaaacagaggctattagagctgggggaagggagggagagagagagacgtgttgaaggatacaaaattccagctagatgggaggaatacattctagtgttctacaccactgtaggatgactgcagttaacaaaaatgtatagtttcaaatagctaggaggaggatagcaaatgttccctaacgcaaagaaatgataagcgctagagatgatggataagctagttgaccggcatctaatcaccacacattgtatgtattgaaacatcactatgtaccccatgggtatgtgtcattatttgtccatttaaattgttttaaatttcactttctggttgttcatagctaatatataaaagtagatttgacattttcccttgagttcctgctaaattcacgtattaggtctagtagttgtcttatagattccttaggagtttccatgtccatgatcgtgtcatctacaattaaaaacaattgcgcttttctttcatatatatatgttcatttgtatatgacatttgcatattgatttacctataatgtacatatgatgtgtacacatatgcatacatatctatacaggatttttttgcctatgtcagtggccaggtccgtcagtgacaatgttcagtgaaagtggtgtgagtgggcgtccttgacgtgttcctgattttaagaaagcgtttggtctttcacaattaagtacagcgtaagctgtagatgtttctcctaaatgcctttttatcaggttgagtgagtttccttttcattttagttcctagagagttttattttttcgtaaatgggtgttgaattcggtcaaatgctctttctctgttgatatgatcacggtattattctttgtcattctgttaatgtgataaattacgttgattaaatgttggctgtgaaattgtcttgcattcctgggataaattccatgtggtcataatgaatgctttgtacgtgttgctaagtacaatttgttcacattttgttaaggacttttgcgtctgtattcttgagggatgatgctggcctcataaaatgagtttggaggtgcttctcccttctctattttcctaaataattggtgtaatattggcattatctcttccttaaatgtttgatcaaattaaccaatgaaaccatctgggcctggagttttctttatgggatagaatttaattattttaatagatatagagctactcatattttctgctgcttcttgtgtaaattaaggaatctgtctagttcatctaaattttcaaatttagtgaactaaatttgttcatattgatttattctccttttaatgccagtagtctctgtagcagtatttcctctttcatctttgatataggtaattttatggctttttattttcaaataaccaacattttaccttactggttttctccattatttgtttcctattttattgatttccacttttatgtttatttccatccttctatttactttggttttaatttgaacttctttttctgttttttgtgttttgtgtttttttttttttttttttttgagacagagtctcactctgtcgccccggctggagtgcagtggcgcattctcggctcactgcaagctctgcctccggggttcatgccattctcctgcctcagcctcccaagtagctgggactacaggcaccaccaccacgcccagctaattttttctgtatttttagtagagatggggtttcaccgtgttagtcaggatggtctcgatctcctgaccttgtgatctgcctgcctcggcctcccaaagtcctggaattataggcatgagccactgcgcccggccctttttctggtttcttaaggaggttgcttagggcatagattgtaaacctttcttcttttttaacataagtatttaaagctataaatttccctccaaccactgccttagctacgttctagaaatattgatgtgttattttttcattgtcatttaattcaaaatattttccaatttctcttatgagttcgtctttgattcttaagttatttagaatgtgttgtataatttcccagttgggagcattgccaagctatctttttatgattgatatttattattgttgttatgtcctagtgtatggtctacttggtgaaagttccatgtgcaactgaaaagaatatgaagtgtgaaacgtatgtgaagaatgatggtgggactctggtataatcatcttggaaaaagtatttgtcattcttgtgttaaacatatacctacctatgacctagccatttcactcgtagatgttcatccaagagaactgaaaatgtatgtctacacagaaagttttacattaacattcattgtagcttcatttgtaatagccaaaaacaacccaccagtaggtgagtggataaacaaaattggcgtatctatacaatggaccaccacttaccaaaaaaaacaaaaaagaaaaaaaaaacagctcctgatactggctttttagatgtacctctttgtattttagtggttgctctagaagtttacattgtacatctttattataacctacttactgtatatctttattataacctacttactacctacaccttatatgtactacttcccattaagtgtaagaaccttgcatctgtataattaattccattggcaaccatgtttttgctattgctgtcatatgtttttcattaatataaacccaaatatacattgttataattcttaagtaatcagtattgtttaaagaaaataagagaaggaaaaatacggtatttttctttacctgtatattcccacttcctgtacccttcatttcggtctgtccatctaagtttccatctgggaaaatttcccttctgcctgcagaactttttactgcagtttttgtagtgcaggtctgctggtaaggagtgatcttggctgactttatctgaaatgcctttatgtctgtttagggtttgaaaagtagttcactgcacatagatcttggagttgccttcttttttttttttttttttttttttaagacggggtttcaccatgttggccaggctggtctcaaactcctgacctcaagcgatccgcccacctcggcctcccagagggctgggattacaggtgtgagccactgtgcctggcccggagttggctttttcttctttctgcccatacacttttttctgatgggaagttgccaggcgtgtacaacatgtcccggctgctttcaaggttttctcttaatcttggggtgtccaagagtttgactgtgataggcctggctgtgtttctttatccttatattgcttggagtttgctgtgattctttgatgtttgtcaacaaattcatgaaactttaggtcattgtttcttcagtttttttttcctgcctcattctctctcctctcctgagacatcaggatgtgagttgttttaatattgtcgctcaggtccctaaggctgttttttcattgttctttttaatcttgttactctctatacttttgattggagaactttttaaaaatctctcttcaagttcattgacccttacttctgccatctccaatctcttcttaagaatacagtccatccagttaaatgtccaattttcacttgttatttttacctttactttttgtcctagaattttcctttcttttttctttgagatggggtctccctgtgttgcccaggctggaggtcatgcatgcagtggtgtgatcatagctcactgcagcctcgaactcctgggttcaagtgttcctcccacctcagcctcctgagtagctttcaagagtgagccactgcgccctgtcaaccatggacacttaaaaacagaaaacatagcataaagccttcatgccatgctttacagccatgctttgagcacctactatgtggcaggtaccatgctggggacaaaaatgtgaagaagggaggcccctgcagggcaagagagaaagacaggctttagagtaatcaagaaacagcattctgtgggagccctaagcgggtgcctcatcttgccagctgacagggaggactcctggaggggagcctgtgtgttgaatcttaaccaatgagggggcattagccagggcagaaagaggaaggcacagctttgggctgagggaacagcatgggcaaaggcacagaggccagacaaggcgggtgcagaagaaagtcccaggcaggagtaaaggcagtgtccccacccactgggggcccccaccgtggtggctgtctggtcctcacggcggccctccgcgggtggggtgggatcagagcttgtctgagctggtgaaggcgggactcatccctgctgtgtctgggcctcctggtgcggtcttccgccctgacatgcctgggcacctgggagctgacaggtacagcacctttccagagatgtaaggcactggatgggagactctgatctgtaaagaactggctgatgggaagcgcctgctgcattgatatggcatctccgccccaccgaggctttgaaaatcaaatactccccaagctatggaaacccaaccacaggcggactgttaggactttattattataatcactcggcccaattccagccaccgcgggcagaacaatgagccattgaatccttgcagaggtctcgcctctcccatgggcagggacccggtgctgaggccttggcagggagggtggtggcaggcctgtgcgctactgcacagcccgggggcccgtggggggtctgggcttcggtctcctcactcatcgagcaggaggcctgaagagaacacatccggatggtgctgcactctcctgacattctgtcccacattgtgacccttgtaggtcaggaactaactctgcttcagggagaccatgatgcagaagacaccagcgtccttcgcagtcctcagcatgcatggcctcgcctatataatcacaaaaagggagcctgtggggtgttcccgccccaagctggggtgcctagtataggggtggccctgggagtcccagctgggtcagaggccagcagccagggtagagggctgggcacagttggctgcacccccagctgctgagttacaaggccacaccacctcctgccggtggctccactttattctcaagcatttggtgttatttgatcaccagttataagccaaaaagattccagttttaattaggggggaaaagttccattctgtggaaccgcaaggccccatgattgtcccacgaaaccctagaggccaggacctcgccaggcttgagccaggtctgccctgcccttcggtcctgcttcaccggcaccgctggctttgcatctccatgtcctgaacacacttgggtttgttgggcctggattttcactcctgtgggtgcccagccctctgccctgcccctgtgagagtcagctaccaaccaaaaggcacagcgggggaagttctcttctgtctccaaagagtctctgcttgtccccctcactgggaagtaagggaaggctctgggaacgccagcttgggttttgggattagggtaacctgagcaccgtacaccatgtcagggctgggatcaggcaggctcgggcctaagatgctttgctgggccccacagacggccccctcgctgtcctcataggcacacaggattggctgggggccaggacaagcagggctccagaaccctctggcggcaggaccagaggtcagggagatttgagggagttaggccacgcctcgagagcaggcataggggaagatgagggacagaagggtggtcagggtgcggcaggagtgaggctcggctgcatctgcaggacagcaccaagggcccacgggcaccaggcccaggtctgaagctgcagccctgacggttcccatgatcaagtgtgcagggattaaggagcagtatctggaaaatgggcccacagtcttgcctctctctcccagggttgcccagaagacccatccagggtgttgacagcagcaatcactggcatttagtgcatggacttggccgcagggcgtaggcaccgtgtgggttgtcgtcctccactcctggccagtgcaggcagtctcggctgctgtcgcctgtattccctgacgacccgtagtgccagcccgagctggatgctgtcaccgcctgacggagcgcagggtgtctgtggcaagtcctcaactcttggccaaacttcaccctgcatggtggattctgggaacagaaatcgatgatgccagccacgcctgccgggcttggaggtgggccctgtggctgacgctcagggggctgctgcaggtgaggcccaaggagcgcccaggtgtccggggtcccatccctcccacactctgcctcccagaaccccgtcggggctgcatcacatccatttcctgggttatcagtctcgtggcagctcttgcctgttgaagaatcttctgtccagctatttcccaagctgaacattccaggttgtggctggacaggcccttgcccgcctgcccccaaccctgagctccttccttcactagcccaccagcagctcggctccctgcagccggccccgtgggacctggtctgggcaggggcacagcagagctgggatctgcacagcactggagcactggatcctgcctggaagagcacagcccagaagccccaagcacaggggggaggcccctcagcccgggcgcagagggacatgggagcacacggagccagttcctccctgcctgccttctgctcggggtggcagccaggacgccagcgtgtacctctttatgcccctgcctggtccaggaagaacctcaggcagcttgcagggccatgcagtgcccagccagagagcccagctcgaagatggtggtagaggaaggagaccaggctgggcataggatgctcccgtgccaggctctgttgagctctgggcttccgctgggagggctggggaggggagggccagggagacagaggtgggctagcccaaggacgcagcctgggggcccatgggaggggtcttgtgggccagtggccctaccaggacgggcgtggggctgctgcctagggctccatggaagcccagggagtgggatctggaagtctctctcagcagctggctggctctctggcctggccaagcaggcaaaagtaggggccaaggtgctgggtggatgggctgcggggtccctggtggcatgggggcccacgtccaggccctgctagagcagtcccaggtggggggtagctgggttgtggagagggacaccaccccagcacactcccattctagtcttcgccccatgtgagttgggctgaggcccccacatgggctgggaggtccacagcctgtgcatttggggccaggagagggcatcttcctctactgcccaagagtaagacctggcccaggcccatctggatggagaggcagttcagagggagatgcttcctgatggggcgccctgtgcctgggccttaatacctgtaggggctgcaccacctgccctggccactgatgctggcccgctggccttgggtgtagaccccctgctgcttcctgctccagagggtggggatccccgtgtctggcaatgaatgacccacaccaaccctcctggaccctgactaggcccaagggtgggaagtggcgatgagtgagggcaggtgggcagaggccagcaggtctcatcaggctgggcgggaggatctcttgcccaggacaggggcactcagggaccctggggaggagaagtggctcccagagggacacggggtggggcagcagcctgggaccgagaccaggaggctcaggtggctctgagctctgggaggcaggagtggcccccacccaccagcccaacgcagacaccaacacgcttctcatgccacccactgaagccaggtgccaacctgtgctctcttggggagggatgtgagcatggggcggtgacgccactaggatggagcctcaacccgaggtggcccaggcacctggagcctcaatagggcctggaggggttagtgtggcctcatggccctgccccgatgagcacactgcccagccacctcagggcatccctcattaaaggtcttgggtcacctccagttcttgcccagtgtgtgaggggtaggtgggggcctcaggcctgcctctgggtcctgcttcaacctggggaggggaccagggcccagtgcccaggcactggcggcacctccaagctgctgcactggggctggagtggccgtgggccaggtaaggcaagcaggtgtcagccgaggtgagctcatgtgccaagaccctgtgggaggagcccaaacccgaggccaggaaacaggtgctctcaactgcagccccaccaaactgcagccccacctgacgctgctgctctcacaggggcagccctgcctgagggcctagccagcactaaggtcacctcacggccaggagagcagggccgaggtgcccgatggctgccaagtgaggctagggccaagcaagggtgcagcatgctcagggagggggctgcagtctgagcatctcagttacccctccccttgagctgatgacccctgctgtaccccctgtccactcctcagagccctgccaggccctgccctcccctgctgccccgctgtggccctcgaagccctccataactgtgtgtcccctcccctgcatgtggaccacccagggggcctggggaactgcccaatgtcactcaggggtgttgggggcaggagagggtgacactgccccatgcagggtgtggcagagaggggccactcagcctcgctgggcagcaccccccgcccacttctcctgctcccacgtctttgcgagatccggtgccacagcagaagtgtggaggatgtcgccgggggtaattgcaggttacacagaacaatctgaggaattaaagtcatatttttattgcaccataaaaacatgtgaaggcggcaggacggcggccgcggggccaggcggagagcacccggctctggccccaccctgcactccctgggccgtctccagggagacgcaggatcgaaaccactgttggcccagcacaccggtcccacgctgggcaagggagaccgggagagcggccgctttgcccacattgccctgctgggccctggttcctgccctggctgtgcagctgcctgggtgggggctctgggccagtgtcccaccagagtagtgaggtgtggggatggcctgtgcctgcggggtcccctgggcctggtctgcagccaggtgcctgccagttcagcaccggccctgagagggcctggggcagcagtgctggcctctttgtggccactcttcacctgcagcacccattgcttgtaaactgggctggacccctgcctaccacttaccaggagggtatgagcccctgtgcagcaggagcccaaggacccacggctgcctgggatgtgtgtggtggatgttttggtccctcctaggggatgtgcaggccggctgaatgggccacacagcgtgggagagccgaggtcacagagagcaggtgtgtggtacacggtgtgttctgggaagaaggggcacgcagagaaaaccacctggaggggccagtggggacatggacgtgtgggtggctctcaggccaccagcaacaggtactcctggtcggctgggcagacagggaggcaagaggccctcccggcagaatgcggcccagtgtgtagtgcgggctccacacagctgcatcctctccatcaccacaaaagcaccaaggccatttcaagctttccccatgctccctggcaggggctgatcccagggccaaggaatccacaggccctctgcccccttcctggctgctgcccagagccaccccccagagcccaggcagcaggtgtaggctgacctcccagcctggcggtgcctccacggcaaaaaaaacttgcaggcctagaggcgagccccacccacaggatccggcccaggcatgccaccagccgtgtgttaaatgggacacggctgatctagagctgcacttgtgggagggcctggcccagcacttggcatcttaagtgggcgtctgagagctcacgcgcacgtttcacacagcaagtcgggctcctgcaggcccattaaggtgcaaaggcattcctctgtgtgctgacaagcagggtcccatccacggctccgggccggcagactaagtgatgttttcttaaggaagacacgcgattagccacagctaaagccccagcacaatgcagggcccggccatggctgtcagcgctgtctctcggcagtgactgacaggcactccccagcccatcaagcctcaatgcacaggattagcctgacgcagccgacaagctgacttggagggccacggtggaaaaccggcaaagtgactgacatccggggacagagagcctcacacagccctgctacctcctgtcatgggcctgcctgctggcgggctgttccagaacaaagccggtgttgccgcccctcccaagagcctccctggcactgggctgcccttcttgcttcaaggtgcagagacctaggcagagggtcccaggaaaaaccctcagtgggcgtcttcaggccagaggccaggcagctgtggggcaggtggggcggctccgcctcctgcctaagtggggtccctagcactgcaagtctgctcccctctgcccagggctgcttggaattgtgctcgggggttcaaggggccccagcggactctgggctgccctggatggaagctactcacgattgaagaggggcctggtggcctggccagaccccacccacctgggcgatcctgggggaccatcagggacaccgcaggcagagcacacttcagaaaaagtaccctctttatttgcattgcagaaatgccagggggctcggacatgggtgcccacagggtaggtttccacccaggtcgtcatcatctggcaccaggagcctgggggggggtgcccggcggcagaggctgagaggtgcaggggtgaggtggacagtcccctgagccatccctgtggggcacacgggccacctgtccagcacttgcgctccacgctgaccatctcacaggcgctccaggagagggttgaggccccccaaacctggcctgcagccatcctgccaacaacaggaaggtcagcacaggtcagccacccacccctcacatcagcctagctatgtctcccactgccacacccagggacccccaagggagatgggtgagaaataaacccagcagagaatggccccaccccagggcgatgcgtcacagggagcgacgcggtgctacaaaaatattttgaaatgataaaaatttatagcaggctcctaacaaaacagctctgggaggtgtaatgttctgataagagtttcctcaggatgccctttgtttatccctatcgagcgcggccccgccggggggaggcggccacggtgaagcagggggccctgagtacccccagagaggcctccccagagcccctcggcgccatgcagaccctagagcctgtccacaggcatcttggggggagcccactgctctgcctggtctccacctcagccccgggggagagatggagcccaaacaccccaaccctgggaggggctgacagccatgggggtgccccaggtgggctggatggcacgggctgagggcccaccctgccccggcccctgccctgcagcccaggccggaggatgcactattagaccacgaggcgagggggctctggcacaggcatccctggggcagaggccaggagcccttgccagtttcttcctccccagaagaggtcacgatgaacaacatgccccccggtcagcctggctctgcagagctggaacagaaccagatgtgcagggcaggctgggcagggccggccatcacagggcagcgtctccaccttctgggagatagggaaatgagcgggcgctgaactctgcaggagccaggccttggtgggaggcctcggtgggaggccagcttcccgactgcagccccctgtggggcagcaacttgagatgcccgactttagcccacccgggacaccttccacgccaacatccacctgggataggctgctaaggatgagccccgtttcttgatacctcctgtgtgtggggagcagctgtggccaggccggggtctggggtcccccggggaggtttgggcccctgggaacttccccttctgcctgtcaccgctgtggcctggttacaggatggagcacccattctgggtggcgtggcaggtgtagccttgctgtacacctggagggagcccatggccagggctcctgcacccctgccacatgccctgtcctcaaacagagccagccccacctgcatacctgggtctggcctccgaggagctggcggcgggcgcaccgtgtgccctggcctgcagggatggcgcttaccctcagcagcctgtcaccgtggggtccaggcctgagcgcttggagatgcgcagcttgactacctcctcagagcatgtgggatggatacccacggtccgcatcacctgcgcataggaagccccacacctgcacatgggggatgggggaggcaggcggggtcagcacagggaggggggtccacagcatcccacccccgggaagaggagggcctcagaggctgctggtctcctcactgtcccctgacccccagccagcagccaggacccctgcccacacccgtgggtgccatccacctccctcccagcagatgcctagtgctcgtccagcccacctcccacccagccacgccctggcttgccctggcctggcttcctgctgttccatcctcccctgctaggcacagtcctgccttaggcctctgctctctgctttacccacagacagcgcatcctggcctcaccacaccaccacctcccaggccccacatccagccagccacctctctcaggccatgcacaatgtcccaacctccaactacccctgtcaacccacccagagcctttgccatggcttcctttgaccccgggaccccgaaaacacacagcctgagcccaagacccaggcaatggccccagctccagaagacacacagcagccctggggtggctctccaggtactggcactctgctcatggtggcgtggtgcttggccaggtgggcaagggccctagcagcgacccggggccacaggggacacctcacctggctctggctggctcaacagcgtctggctggggcagaaccgcctcttgtccccctaaaacccgccctgtctgaggggcctgaggaatctctgctgcaaacccacgaaggccacataaatgccgcaagagtggcagcagctctccactgtaggactgccggcactcgagggatacccagctgcacatcgcatcgcagcctgcattcctcgggacttacttgatccccagagcaaatccttgagtaacttcgcctgcgttggggccaaggaaatgcaggcccagcaccagctgtgggggctccctcaggcacaccatctgaaagccgcacatctcagccaccagcccaggagggggctgggttgcgtccaccctgcatccaccctgcaccctgcctgggaggcatgggtggggccagtcctcgggtgttcaccctgccaggctctttgccaccctccctctcatcctcagcaccctgggccacagggatgctcacctttacataacactgggatgcatctcgtccagccaccgtgaactccagtggtttataatgggcgtgatagacctgaggacaggataccaaccctggatcagtgctgcgacaaacaaacctcgtggcacctgcagctcccacaggctgcatgggcaaggcagggtcatggcgggcaggaaccatccatctggcctgaaggtctggtctgggatggggatgagggcttggctggccacggggtgtgtgcaggccctctcacgtgcaggcagccagtggctggagccatgctctgcaggacagaccctgtcccacccaggcctgggacccccgtaaaccacagcagcagagcaggcatcaggcaatccaagcagccaggccaggcacagcaaacctgggtggacgtagctcacccacaacaaatggtggaggcaagaatgggtgagcaggaggccacctgggctccctcaggcaccctggtgtttgcttggccctcactggagcaaggccgctgtggccacaccggagccggagctgttggacaaaggctttcagcacccctgaagggctcgacagcgtgtccggggctgcggccaagtaaaaaatgagtggggccctcacatgtgctgtacagccattattaattaatggaacttcagagaatattgttctaactaagacagaattgaaaagaaaacaaacagagtatttggccattcaacattgtgaaacataaaacaacattataaaatgccaggaacatatgtcccagcacacttgtgatgaatcaaacaaaaatagcaaataaagtgcctcggggaaggctggcctgtcaggcccgtcctgttgatggagagttctggggtgcagggggaaggggccagccctggagcccagtgtctcatccccaaaggccgcaggccccaccgcccaggctgcaggctccggtttctctgggtgcctgcaagctgcagcggcagcaagatgaaaccgcaccgaaggcttccagctaccacggcccggcaggcttcagagcccccgcatccctccaggccaccccggagccacagccacctgccagagcagacccccaaagcaggcttgctcgatgaaaacccctttcctcaagggtgagtgcctgagcctggaagaagctggaagaggatgggtatcaggatgtggtggggggcggggggcggggggctctcgcctgggagaaaccctgggcagtccaggaagacgaggtgcagggtggtggggggggtgggggtggaagcagaggtcggaggcccctgggagaaacttttctgggtagagtgagattcatggccctgcaaggtggggacagcacagaggcatcttcggggccctggtgctttcagggacaagctgctgtgtgctggagtggggccagtgctcagctgacctcagcaggggagcgggtggcaccgtggtggtgaccctgctggtgctgggcacccctgcagcatggctggggtggggctgggggcttctgggccacagggcttctccttgccctcagaacaaggcagccaagggccttcccctcactgctgtgacacatggtggcagagaccagaggcacctaagcccagtcaccccaaggctgccaaagcccaggcacccccacttctgaggctgcccccaacgtgtcccttcccgctacacacagccactgctcagggcccctggaaaggagagaccttggcaccctgctcacaaggcctccgcccagagcatggggtgaggtcgtggagtcgccactgtcctcagctgtgctgctcccaggcctcacctcaacatgctcctgcccgtggcgagccactgcctcctcctcggacagccccacacagccatactccagcggggtgaagacggtcgtgggaacctgaaagcaggtctggagtcagggagggcccttgggccccgaaaaccgaagttccccactgcatgtgacacaaagagcagcgatcacagaccaggaccagatgcgcccagagcaggctgcaagcacagtaggcgacccacctgcccacgcctgcgccacactctcagaactgagccacacacccatgcatgcacacacacgtgtgtacaacacacccacataagcgcacacacacgcatgcccacatctacatgcagacacacagcgcacaaaggcccctcaccccagaagagctagcctcgaactcagcctgtcctaggctgcacgtggcgtcctgctagagaactcacattgtcgtagtccatcagatctgaggacccgccgaagagccgctgcaccaggagcctcccggccatgatcgctatgggtgtcagctcaggccgccccttggggaaggcacaggggggccacgtcagcaccatgtccggggttatatgcagcccctatgccatcaccctttgccctccgagtgggcatctccctttagaaaatccccaacactggcaccgagcatggtgacgtacagcattccccctagagctcgtcctcctgaggggcatcccaaggacctaggtaggttgctcattctcctgtttgctgccctccactctgccctgggaaaggagtccgctgctgatgaggctggccgtgccaccctcacatgctcaagccttctctccaaaccccttctgcacattgctgacctcggagggctgccccatgaccaagctcaaaagagcccctgctaccgttttcattcactggaatccccggctaaaaagggaccccaaagcgttccatgtgctcctgacgtgcagcttgatctgcacgtcacagtccataacaaattccaaatcagaatgtcgctgtgctggagatccctccgtcccagggtgtgcccagccttgggggttccagcaccgtcctctgggatgggctgccaatcaccatggcagcaggaaatgcagatgttgtttggcattccagaaatgcatagagatccgtggagataaactcagagcgcagcctgcgcattccagcaggcctgactaactacggaaacatcccggcgggcggcgcacagcacacaacatctcattaaacaatagcccccgccccgcccacaggctcttcccagccgctcaagggaccactggttgggtgttaactctttggactattcagaacgacctttctgacagagtggatttaatgtttaaataaagaatgcctttgtgtgcgccatgcatttctggcaaaacggtttgaaatgttccagtttccaacacaggagcctgggagctacacacttgcagagggaaaactcagattcccagacagaagggaggcttcccgctgtgcacagagatgcacatggcactgtctcagggtgcagcgcccacaggattcaacagaccctgcaaccagagaccactgcacctacatggtccacaggcagaggctgcgcttgcagaaatcactgagcagctgaaccatccagctaagcaagctggggctgcagggtggctgaggcacatggagccacatgctctgtccacacaatcgggtcggctagatgggccctacaggaccctgcagggtctgcctggagcctcagagtgtgaccttatttggaaataagatctttgcagatacaattaaggtaaggatggaaatgaagtcatcctggattagggtggaccctaagtccaattgcagagaaactgtaagaggcaaatcagggcccagagacacacccaggagactgtcacatgacgatgaggcagagagaggagtgatatagccacaacccgagggacgcctggggcatcctaccccagaggcttccgagggagcctggcccagctgacactttctgacatggagtctcgctctgtcacccaggctggagtgcagtggcacaatcttggctcacggtaacctccgccttcctcctcccgagttcaaatgattctcctgcctcagcctcccgggtagctgggattacagatacgtgccaccacgcctggctaatttttgtatttttttagtagagacggtttcaccatgttggctaggctggtcttgaactcctgacctcaagtaatctgcctgcctcggagtcccaaagtgctgggattacaagcatgagacactgcacccagccccagctgacactttcatttcagactactgccccccaaacgtgagataatccatgtctgttgttctgggccacccgtgtgtggtgatttggtaccacagccccaggacgcagacactgacaggtctcgctacaaagaagctctcagcgaccctccagagccactttcagcagcaggtgctggacacatgcaggacaggccgagcactcctgaggctgccagggtgcagtatcccaagactgaccaccacagtcccttactggggccatgtgtaaggagggctccagagcccccacccaggaaagactggcaccggtctccacttcacagcagcagcagcagctgagagcaaaggacctgccccggtgtgatgcccagagaggcaagccagaggatactgaggcggggagggcggggccaggtgggcccgaactagacctgcctctcaaccctgtggggacaggacggccccaaggccatggtggcatttctaagcctatgcctctagcctacctgccaggggttgaggcctgcgtgcagagctgacccatgccccattcccagcaggcgtctgctgctggtgcttgcagctgtctttagaccatccacactcccaccacagaaaggaaaggaaaggcagagagccgaggcccatgtccaggttgccccagaactccagacaggctggccctggggtttggcccagagcctctgtcatcagagaaagtgtcgtttctctcctacaggacggcagcagccggagcccagcgagcaggggtggtggagcaggcaggggcaggggccctggtcccgggacgcatgccgtacctccaccacgtcaccaatggcgtagatgtggggcacagaggtggcttcccgggagtccaccaggatcttctgagtgtcggggctagtatctaccccagccttctccaaattcagacttctggtgtctgggactcgacctgaaggaaacagagagggggctgaaaggttatcttcagtggctttgacctagagcggttgtgtttaaactgtttctcagaatgtccacttagagaccgggtgcagtggctcctgcctgtaatcccagcactgtaggaggacgaggtgggcaaatcacctgaggtcatgagttcgagaccaggctggccaacatgatgaaaccctgtctcagccaggcgtgatggctcatgcctataatcccaacactttgggaggccgaggcaagtggatcacctgaggtctggagttcaaaaccagcctggccaacatggtgaaaccccatctctactaaaaatacaaaattacctaggcgtagtggtgcacacctatagtcccagctactcgggaggttgaatcgcttgaacccaggaggtggaggctgcagtgagctaagattgcaccattgcgctccagcctgcgcaacaagagcaaaactctgtctcaaaaaaaaaaaaagaaagaaaagaaaagaaagaaaccctgtctctattaaaaatacaaaaatagctgggtgtggtggcatgcacccgtaatcccagctacttgggagggtgaggcatgagaattgcttgaacccgggaggtgtcggttgcagtgagccaagatcacaccactgcacttcagcctgggcgacagagtgagactgtctcaagaaaaaagaatgtccacttagaactggccaaatgtgaagcaccagcagcgtagaggggctcctggcctctgcaggaggtggcaggcaggtctgaaacggacactggtcagatgacagccggcacaggagacaaggcaggggtgccaccggtggaaactggagtcggccttagactggttcctggcacgcgggaaaggaagaggcacttgccaatgctggggctccctgacatcaaagagtgctaagcgcgggactccagaatcttccgcatgcccaggcctcaggccctgctgcagggccaccagcacagtgccagtggctctggtactgacttcatccggagaaaccagcccttcatggggagctgttggcacctggcctgcctggcctccctgcatctgtctgcagcaccacagcctgataccattaggcagtgagatccatcagctcccaggcctcaagagtccagaggggcctccttcaagggacacctgctggctcccaatggcctcctccctatctggacaagctgaagaggagccagccacaccctggactgtaccccaacaatgctcaagtcctgggatctggccctctgcccaggtagggcttgaaggtctctccccattaggagaaagcaagcccccgtaacccgctagtagagggccaggtgagcagagctagcagccgggtctcccacctgctctgtgctgcagcccctcgtggctgcctggcacacagtcccagcctagagacctcagggccaaggggagctgagctaaggggcagtgtccaaactacaccgtgcccattctagggggcagctggctcagctgatcctgctcttgggtgcaaaggccaagaggggcaggggatggccagtccagggggtcagcacagctgccccctgccagtctccacacagcctggggcccggagagagggcaccgcatgggcctcttcatagccgaacagccagcagaggtccctttctcccctaactcagatgggtgtgattttgccaggccagcggatggccacagcagcttttccctcccaaccccaggtgctctcggctcccaggggctcaggatgatccaccaatggcgaaggcaattttgcctcaaaagcatagctcccctgctcatcgtggctgggacaaaccagctgctggccggtatgcgggtggcgcccacctaagcatctggaagctgaagctcccgtgagagggaacccttaagtctccagctgctgtcccggggcaggagtcaaaacataccaacttggctaagccagcttgcgggaggccggctccagcctctgtgctctgctcagccgcaggaattgggtgccgggagggctggcaccggtcggggatcagcccagacacaggggatgccagcccacatcagaggaaggagctgggccccatgggcagggctggggcacgaaggaggggctgtggtccctgcaggccgggggctcacgctcagccgtctggtccctctccaacctggtgtccagcccaccaggcccagcacttcctggtgcctgctccgtgccggaacagaacatctgacgctgcacccacactctcctctgcacgcttgcctggctggtcctgggaagccaagagcactcatcatgttcctcatggtaactatggcactatggcaactacagaccttgcaggtgctgaccaaaccctgtccccaggtcccgaaggaaataaagataaatttaaaagtagtcacaagagataaaagaggcatggaaataggtggcccatccaaagccaggactcttccgcacatgctctgtggatcactctgggaagtcggtgggaatgtaatggagccactaatgtgaaaggcatgacagctggacaggctggatggccaggggagagtgggctgcgcggcacagacacgcctggccctgcagggactccacagcccttcgggaatgaacagcaaaagaagagtgagtggcctgtggcaggcagcaggctcagccctgaggagggcagccgagggcacagtggggttagaagctgggctggtgggacgtggctgggagtgggtgcagggaagaggccagctccacttgggtggggccacgtccctagccgtggccagccctgatggcaggacaccaggccctgagccccactatgggtcttgctgagcaaaggactgggcagtggccagagaagggccagatctccctgctggtgctggacagccaatcaggcgtcctaggccctactggctcaggcctggagccctgcaggaggttggacgacttgtgccaaggtggggacccactggggcccgaatgctgtgagcagcaggatgcaggtggctgtgcccagtcagctccccaccatttccctcctatgccaggataaagcagttgtgcctggtcagctcccgaccatttccctcctatgccaggataaatgtgcactattcaggccatttagggaaagaagggtgcctgcaccggtgtctttcgccctgcatgttgtgctcagagctttcccagctgtgcctgtggcccactgcaggcctccccatggggcggctctgtgctccctgcagctccgtcctcgaagccttggctctggagtgcccagtgcagcatttgccaagtgctgctgaatggcccctcctggggtaggacaggcactctcaaggctctgcttcctagacaccaccaggatggagacctggggcaccagcttgccatgtgtcagttgagttcctggggcagaccctcaaaggaagggcggccagctgagtgggggcttctgggcgcagggcagtccttagactctgttccttcctggggcaggcggcgcacagcactctctgtcatgctgctttaatttgcacttctttgatgactagtaagatgaagtaatttttggccacgtgtttatgaactgtatttcctcttttgtaaattaccagttcctgccttttctcatccatttataggcatcttcaccatgttccttctttgtaagagcttattacgtaatggatacatgacactctggcatattttctgcaaacgacaagggcattaaaattccaggtacagctcttcaggctgtattcatgagcagtcgtgggccacgggattcgtgggcagaggaagggcaccagctctgtgttccttgtgcacatgaagcaggagggctcataggcctgcatgctgtggacttagctgagcggcacagctacatcaagggcaccttgaaggacatgcccctgctgagatggtctccaggatccacaccagtttaagcagcagacagagctgtccatcaccaccaagggcctccacacgggccaatttctgtttgtgtactgtagcaagagggcccagctggacgtcggcagcgtcctccctgcaggcaccacacctgtaccatcaagcgctgcctggaggagaggctgagactggaacttgttagcctgggcctttgagaactacaccgcagtcacctcccctagcccggaaaccaggaagacttacatgaagctgccctccaagaggatcatctcagccaacagagctgtggtcaatgtgggagccagaggtggccgaactgaccagccatcctgaaggcaggccatgcccactacatataaggcaaagaagagctgctgaccatggtgcagagtatggccgcaagccccaaggaacgtcccttcagagatggcaaccactggcacgttggcgaacctgccactgcagagatgtctctgctggtagcaaagtgggtctcattgctgcccactggacttggttcagaattggggctgatgggcccaacaaagtttgtccttctgccaaaaaaatagtaattccaggtacaaatggacgtgctcacttcctatgtatatgtgtggctggcccacaacactgacactcaggaagcactgggctgagcatctctgcagcccggagctgcctccagccccaggcccagcagtgcagcacccctgacgcaggacagcccatctccatgtgtggccagtgctaggaacagccgtgcagggcagccctcctctgatcacaatgagagccccaccagctgctgtcaatggcccaggagatggagggcagccaccatgcttgtccagccagcctggccccaaggagggaccagagaaggctgaagcccaaaaaccacccacacagtcaccatgggtcactcccatctattctgatggacacagggacacggggacggccagccgcatgcagtatcatgcgcctctctcatccatgatgggaagaacaggcatgccctctgatttcacgcccgcctgggacacattttcccaagagaagagcaaggaggcagcgccccaggtgagaggtaagtgccagcaggagtacagcagggtgagccagtggctgtgatccagacagaggcagccagggccaagcactgcgcctgaggacgagggtgtgggagtgggaggctccagggccggtgggcgatgcgaggcgggcacggcttcacacacaggccctgtgggccacctggcgactgtctcatgaggcatgtggcccccagagccagccaccctcacggggcctggcctgccacttgccccagtgaggcaccttggaccaggcacagaggagcgtatgcctttggaactggacttagattcttgaagcttattattttaaaatatttatcttctttttttttttttttctggaatcgcaccttctcaatgagccccgggcccctacccgcagctatgagcccaccagggggaaggggacgcacctgccctgctggcctcaggtcccatcgagacgccatgttagttgaataaatgagtgagcccctgggcctcaatgggacctgattggccacttgctgtgactgccagcagccaccagggacccctaggccgttccagggatgtctcatacccagggcggctccttggggggtgggggtgagcttcccctcaggcagcataagggcctttcctactcaagctgcctatgtgcattatgatgtgtaagaccccacagtcagccttggagtacggcgcagcccccagctcaggcccagaggacccccaggaaggagcgtgctctgtggcgagtggtcattattgctttaacagttattattagaccgggtgcagtggctcacgcctgtaatcccaacactttgggaggctgaggcgggcggatcatgacgtcaggagttcgagaccagcctggctaacacagtgaaaccctgtctctactaaaaatacaaaaattagctgggcgcggtggcgggtgcctgtaatcccagctacttggaaggctgaggcaggagaatcgcttgaattcgggaggtggaggttgcggtgagccagatcgcgctcctgcactccaacctgggcaacagagctagacaccgtctcaaaaacaaacaaaaaacaattattattattattattattattaattatttgaaaagaggtttcactctgttgctcaggctggtcttgaactcctgggctcaaatgatcctcccaccttggcattccaaagtgttgggattacaggcatgagccacctcacccggccctttaacaattgttaacataattgcaattgtaacaggttggctgccccagggcacctgcagacattagagggtgcatggtaatatgcataaatggtgctgacctatctctagaagacttttcaccatgttgttcttttttttttaattggtttccactcagttctaatcattaagtactgaatttgtcatggtaacaagacccagttggacaaccatgtatgcaggtgccggctggcctgtcagatagctgtgggctctggacataagtgtgaactagccctcaagccaagcgtggggcaccaggctggtgggtaagcacagggcgctgcctcctgctactctggcctggcctctgtgaggtgttagcaccaccatgagctagggctgagccaacagtgctgtctcaggagcagcagcgcacgcccggggccacgtggtgtggaggggaaggccgcagccaccgctcataggaagagctccatgaatgttcatcttggccccacttcaaaaaatatcaaactcacaatggaggcagatttgggtctctcttgatgtcattaattacaaactaaatttgcactaaaataaaaaggtgttagactatcaaagaggggcctccgatccgtgtcacctgctcagggatggccactccaccctgagagcatggaggcatgtggatgccagggtcactgctgggcccatccccaccgggaagagcatagccacaaacttggtttcacgcagctgcagcaaggcgcatccctgagagcagtcctgatgggcccaccgcagccccctcgcccgggcagcatccacacccaccgcggcccctaagccccagctgcacccacaccagcacagagggcatccaggaggagccgccccttccctctcaccaggcttaggatgctcccacccatccccagcttggttcttgctttctgccctttcctgctgcctggcactcaacagagggacaatccgcagggacttgtgtagctgagtctgcggtgtacgggagccatcagccgagcacagctgagcaaagacagttgcctgccgtgtacatgccagcaaacagtgcctgggtggagagaggagcccagggctgcagcccaccctggcaacagctcccctcctgggcaccgccagcccccatcatcatctcctgggcaccccagtctctctggctgtggtccaggcacacgtgccacgtgggggagactatacaggggcaggctgtgggggtggcctctgtgtggtgccaagaggaagccgggaagccaagctcccatgctccatgcatgttgtgtttcaggctctgatgctggtttacacacaggtggacatctctgagttatctaagataaagcccaaagaggaaatagcttcagtggctggggtaagatccagacggattccttccctgggtctcgtctcacctgccatatcacaaggccccaggcagacctgtggccaccctccctggcactcaggcacaacagctgcctggctgtgggacccccaggtttagcgagtcccctcctgtgtctgctggctcttctggccatgggcaggactcctgtggtgcagggagggatacgccagagccttcagcatctcaccctcaagagagggacagagaaccatccagaggggctggggacgccaaaggggcacatgaagatctcaacttccagtttttcagggctgcagtccagaggcagtctgtcccttctttaaaaccaaatctaaacttaactgcacttagaagcccctgcactgggaggcgtttgctcaggatgccccagcctggccctgctcccctagacagccagggattcaggccacaactggttaactcagcgggcgaattcgagcccgcagcagtgctggctgactgtcttcactcagcgctgtaatcggcacatctgcagacaggaaatcctcctcactgaagttcccagtctattatctgagacacctggtgtgggcgggtgattcagagacaaacaatgagcgggggccccctgcacagcaattaactgctttaactgctaatatgtttaatccaccacgtggagatcaaggctgcgtcgaggaaggggctctggtcctcctctgcttccagactgcagggcccacttcgcaatgccaatgtccatggtcctcgccagctgcggccaggcgccaggcacacgggcaacgggcagggccagcactcggccccacacgggagctctgtgcagcacctgggccccttctgtgtgtgtgtgcaccgggcacggaggcatccccccttcctgtcggagcccagcttgtgcggacgtagtgcacacccggtacaggaagcagagtcggagatgttggcattgccagctgtgccgcccctagggcgctttattttaacctcccagagtggatcatcctttattgcaagtagaaataaagcttggttaaaggcttatcgtacaaaccagcagaaaacgctcgcagttgctgacctgggaagtggctcctgaatgtttacaaaacctggctctgagcagcagcgaagtcagcacatgcccgagcggcccccagcaggcgcgcagaagccgcgccgccctcgggaagcagggtcagaggccaaggactgtgaaaagcttccacccccagcatcaatcatgccaggcagactgtctgggggatgctcattttgaaagtacaaaaaaataaaacagactcctagcaagggaggatgggcgtgcaggccacggcagctctgctgagtagggaggggcctcgcttgttgcctgccaggctgacgccccggctttccggggacacagcccccggcccattggtctgctacatccctatgggcttggtcgagggctgcccctcggttcaatggcaacagctcccttatgctgtgggtgaacggaggtgtcagcagacagaggaggagggctagggcgcggtgggagggagaaactcgccacctcccctttagagtggagtttatttgggaatgacagtaggaggataaattttgaaagaaaaataaagtggagtttaggatgagaaccatcagtacactccagagtccaaaatgttacctaatccttcgtagtgtttatcataataaacttacttaaaatctacttttacaacgtggctgagaacattgctcttgctgactgatcacctccgggccaagagccctgcgtgcgctcaggcatctcaggtcctccccggtcatcacctctgcgcttgtgtccactgcacaaaagtgaagcctcagccgctccaggctggtttcctttctgatttcccattccgagtgactgcttcagaagtgcatcaccctatgacacagcttgtgcctctgggagccctcccccaggagacactgacccctggccagccccacgcaagcccggttagctgatggaggtggaggcaggtgatctgagagggaccctggctctgatcttgggctctcgcaggggacaacggaccaggctcagcacagaaaggcctcggagaactaacaacactgactaggttgctcccgccttcaacatgcaagttgacagggtgattgggaaaactaggagcctaaactagacggccaggcaccgaggtgggtaggacatctgagcaggcatgctgtgtgtgccgccacccaccctgacgaggacccgcagccctccttgcggcggcccatctgcaatggcctcctctgcagcaggcctgggacagagcagtgtctgggcgatccctgttggctccagctgccccttgccagtcccgtcagacagccccggcccaggcctgggcacaggtatcccctggctgtgtccacactccccacacctgctcggccactgccccatgcaaaaccggacctacacctgacagagagcaagaaggtgagaccagactgtgcccagcaagttgtagccagcccacgcctggccgggaaacgcccaggcctctgcccagcactggaagggtgatgtctttggaagccttcgaaatgtgacttctggaaaggcctgcaaaatgccactcctggcatgtgatgacctgccaggcccaaagggacccactgggaaacactgaaagccacgagaaggctggacagaactttaaaaactctgtgtcatttttatgtgctgaaaacaggcggcttgtgcacacccatgttcacagcagcatgatccacaacagccaaaagacggaagcaacctaagtgtccactgacagataatggacacacatacaactcagccttcaacaggaaggaaatgctggcacatgctacacaaatgctaactctaacaaatgctgcaacatggatgcaccctgaaaacattgtgctaagagaaatgagccagtcacaaaaggacaaacactgcatgattctacttacatgaagtccctcgaggagtcagatccatagagacacacagtgaagggtgagtgcccgggcagcagggagtgagtgtttaatggggacagagctcagtttggagataatggaaaagttctagagatggatggtcatgctgcttgtacaatatgaacgtacttaacaccactgaactatatactttaaaatgcttaagatgatgaatttgatgttatgtgtatgtcaccataatttttaaaactttcaaatccatatcatttttatgttaaaaacaacaaactagcttggctgggcacagtagctcaaacctgtaatcccagcacttagaaggctgagatgggaagattgattgagcctgggaggtggaggctgcagtgagctatgatcacaccaccacactcctcctaggcaacagagagagaccctgtttcacacgcaaaaaaagaaaaaaacctagctggaaagcctgaagcagcaaaacatttaatatgctaaagaaaaaatacatactggccaggtgcggtggctcacacctgtaatctcagtactttgggaggccaaggcaggtggatcacaaggtcaggagattgagaccatcctggcctacatggtgaaaccccgtctctactaaaaatacaaaaattagtcaggtgtagtggtgggcgcctgtagccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctggggatggcaagatgggcacagcctagtgtgagtgccgccccacaggccttcacggttgctctcgaggtgcactggggagcggccaacccgcctggcagccagcaggatgggggagccctgggaggtgacaggaagtggggcaaagattctccatgcacctcggggagaccagagacagagcgtgtggctcgacgtgcccttacctatggcccacaggacggtgtcaaaggtgcccgtgtcctccttgccggtggtgctgtcctcccaggtgacctgcagctggccatcagggagcctcctgacccgcgagggggcacagcccctcaggaaccgggtgccatgagatgccatgtgctctatgaccatggaggacatttgctgcaaagcacaagaagacaggccatgaagaccaggtggccgtgggagagaggctctggccctgccctgctctcgaaggcctcaatgaagggcggagaggggtctgtgcggaagacggggtgagacaccctgccccctgctctacgtcctcttgctctctgtggagtgtctagcccctgtcctggctccaagtcctcaaccctgggccctatggtcaggattcactcagcctgtgggctcctctctagatgctaattaactaagtcttcatcagccagatacggtcacacctgtaatcccaaccttttgggaggctgaagtgggagaatccctcaagcccaggagtttgaggctgcaatgaactgtgatcacaccactgcactccagcctgggcgacagagtgagactctatctctaaaagaaaaaataagcaaggccgggtgcgatggctcacacctgtgatcccagcactttgagaagctgaggcgggcggatcacgaggtcaggagatagagatcatcctggctaacacggtgaaacactgtctctactaaaaaacacaaaaaattagccaggcgtggtggcaggtacctgtagttccagctaactgggaggctgaggcaggagaatggcgtgaacccgggaggtggagcttgcagtgagccgagattgtgccactgcactccagcctgggtgacagagtgagactctgtctcaaaccaaaaaaaaagaaagaaaaaaaagaaaaacaaccaaatcctggtacatctacacatttctttaaaaaacaaaaacaaaaaacttagtcttcactaaaaccaatggcagagaagcgtgccttcccccaggagctgtgccctggtccaacaagatggcccctgctcctggcccacccctccacatgtggccaacatgcccctctgccatccaggagccaggagggtaggtaggagactctgctcccgcctagaaatgtaggcacagcaggctcaggtccagatcagggacagagagagtcctgcttctccctcccggcccaggaggcctgtgcgccccaagtccagctacagatgggggccctgttcccaggacaatggggacttgcacggaccagcagtgaagctggccacagcttctggtttcaagaggagaaaaacagtcactgctaacatcctctgacacctgtgcgggtgtgccagctggctctagatggcgtgtgtgggagtctggcccgccgggcagggctggctgtgctgcagaggggctgccgcacaggctgttcatcactcctgcacccctccagaggcctggagggcatggccatcccaggctctgagggagaaccatggagcctgtccaggacacagggtccctcgcccctcagcctggctgcctagactgtgcatcctccttgcctgggcacggcccccattctgcaggcccctttcctcctccgtccactgccagctcaccctccccacatctgaaggctctgaggccttcctagacactgcgtccctaccacagggctcggtgggtttgcactgagggacatgatgggagtgtgccatagctttaggatggaacaacacatggccacacgggtggagggacacgtctctgagtcagcctgggggtggcactgggagtctggagatgacaggcctggctcctcccacctcaggtgacctcctcaggctctgtgagctgagggtcggccgaggacctgtagcagggcctgcagatctgcacagctcaccctgcaaggggcctccttcgtggcagtcatggagtgtttgacatctccacaatgacaactccagacttctattttaacaggagactttcccttgaagagtttttagctaaaaaaagaaaatctctattgctccaatctaggagctcgtcctgctggccacatgagtgtgtgtaccccagacacagatgaaggccactgtacacagcgcacctgtccagaagccaagatcccacgggctgtctcggagccagcgctgccctgtgtccctcaccccagctcacacattacagcttatttcacccccactccctcagaggggacaggcaaggggagagcagggagttgggggtctctgaggtggggctaacacttctgcagcacacaccggcctcttactaatgggacgacccggagggtgacctgctctgccggcacaaggctgggctgagcctcccttcactgtgcctgtggtcggctggaggcctctgtgcagctgtgcgccccactgccaccctcctccctcgctccggccgagtgtctgcatatttcctggacaacctcctcatccaattcaagggttatctctaaagattcaggcatcactcgtggcccatgactgcactgcacctgcctgggagggggctgtgggaggaaggcctcagagccacaggggcgggagctggggcctccagcactacctggtcgaagccgcggagggggatgctgcgcatcatgatggtggtgtccagcccaatcccggtgaggaagccagcacactccagggccacatctgtggggtgccagctaaggagcactgtagatcccaattttggaaatgatgggacaacaccccagggccctgtgccacagcccacaccccacccatccatggctggccctggaggaggctcccaactcaagacccccacctccacatctcaagtgcacaggctggggttagcaaggagccgccaagcagcacccacggactaggccggcctctggcctctgctcccatgtgctgtccatcccggctccagggcgaggcctgcatcctggtggattccagttgggatggagaggagtggctggttcagggaggacctcagccacgggagatgccaggcagctgctttcttccacctgtgctctcagccagcggcttggggcttttttttttttttttttttttgagatggagtctcattctgttgcctaggctggagtgcagtggcatgatctcagctcacagcaacgtctgcctcccaggttcaagcggttcccctgcctcagcctcccaagtagctgggactacaggcatgagccaccgcgcccggccagggactttcatctccctcagatgtccccttgaccccaggccctcctgcagctcctctcctgaccctccctgtctaattgtcccttctgaagcaatgggtccaggctggggctgctcttgagggaggacagcccagctgcctcatggccatgtccagctgtcccagctcaggaagagcctccaggaatccctggccagaggtcagcctcaaactgtccccaggcacagtagatcctccacgccgagaggcccagtaagtgccgatctgaggcagcaaagagcctgccggaagggcgggtggcagggagggactcaagggaaggagtgtccagttcccaggacggccacctgcacgcttgcaaaggatacagctggccccgaccaccaacctgttagagaaacagagagagagcacatgtaaagctgaggcccttattgaccaagtgcagtcagagcagaaccccgcagcctttgcccaggcccttggtcagctcgtgggctccaaggttactgttcaaacagcttgccccaggggacaaagcccactttccaaggctacactgtcaagcatgttgtgaatcagcaaatcgcctggtggtgaagggcgtgtgtgtcagtgacaagtggtacctgtcccctggaaggcacccggaggcatggagaaacatccaccagagcagcacatggctttccttctctccccccggggcctcctgggctagggtggaagctgggagatgcttggcaggatggggaggccaccagaccgcaagggaagacatcatctgagcaaagcactctcaagaccacagaaggctgggcccttccatgtgccagaggcacatccaaccctatcacagctaggcgcagggccaggagggccagctccccagagaggggactgaaggaccccagggacaagggaggcagcacaggacactgcgaccagcagtcattggaaatatttgctcttgtagtgaaaaccctctattgttcaaccccacactccacatgtgttttgcatgcacatgtactcacgcacacttgtatgtgcacacatgccacacacctgcatgcacatactcttacacgggcacaaatgtacacacacacgcacatactcgcatgggtacattcattcatatatacatatgcacacactcatgtagacacatgcatgcacacacatgcaaacgggcacagaacctaacacgaacaagaactcccagcggggcagctgcacgtgggtgggctcccacattacccttcagtctttgaacaagaggaggtgatgtaaggacggataagcccaatgtcattgctaatcccagcaggtactaatgatataattccatttcaaaacacggtgtatcccttggaatcattctgcaggtgccctgcgggaagcatctggcatgcagcttcctcactgtggctggggacagaaccgcaccactgtcaggattagggtgagcagacagagctctgttggccggctgagcacaaggtggttacatgcctcactcagcatgtgaggacagcgaagggggaccctgggacccccagccaagcaggattgcagagatgcattcccagccccgctcagggccggcaacacttgggaaacaggcaccacggtatgcacgcacttccacacatgcacacacacataggcaccacatacacatctctacacggaagtgcacttccaaaatggcgaaaccaaactctttttggacttgctatatgcagtgaaaggtacaagcttttgtttaagatatgaagttatggccaggtgcggtggctcacgcctgtaatcccagcactttgggaggccgaagcaggcagatcacgaggtcaggagatcgagaccatcctggctaacatggtgaaaccccatctctactaaaaatacaaaaaattagctgagcatggcgatgtgcgcctgtagtcccagctgctggggaggccgagacaggagaatggtgtaaacccaggaggtggagcttgcagtgagccaagatcgtgtcactgcactccagcctgggcaacagagcaagactccatcacaaaaaaaaaaaaaagatatgaagttatgagttactgcaaatataaacagaactctgctgctttgcatatcctgccctaaatgcaagggtgtaactgggcgagagcccattgtgtggtgccctttgccccctgctcccagaggtggctgtgcatgggctagatgcttcctgctgggctgtgcaggcactggcagagtgaggccaatgcatcccctctgtgggcagctgggcccctgcacgtcagggccttcctggccctgaaggccaacccttctccaggaatgggccctgcagctgcaggatgggggccaggctgctctccgggcctcctagctcattgctagggatacagcaacacaccctcctgattttgccacaaatgtttgctgtctctgccaccgacgtgtacatccccacctcctacacgatgctgacccaccaggcctggattggagcgggggcaggtgactctccaggccctccctcggagtcccccagtgcccgggcctcctgtcctggcacccacggggcacaggagaagctcccgcctcaagggccaccttcaaagtcacaggtgcccccatccctcagctgccagctctgaatcagcaactgagggtacagctaggaggaggtgggtgcagtgggcatattcccgagtgggcatccttgaccctatgtgttcggctgaaatctctcaacaaaagctcacgtctcgctcgtgtggagggtcattttgggcctcttcttgttgtcatgagcaaggattattgacagcattggttttcactgtacgcctccccgcattgatcaaattatgtgaatgtttaccctttgaagaatgcaggatacgagaattccaacagagaactccgttcagaccagctaaagtaaaaaaatgcccgagcaaaataagacagacaccaaagcctccagatcacagggatagagagtacccaaagacagggacctacagacaccttcttcaggccattcacggcccagcaggggtagggacagacaggaacgtggtgcagcaaccaactcaagccatgactggccacaggaagtcagaggtgctggccacagaagtcaggggaccagctcacaggacctgggggtagggggctggaaccactcaacttaccgctgcattaaaagacccagaggttgggtgcggtgggtcatgtgtgcaatcccagcactctgggaggccaaggtggacagactgcttgagcccgggagttcaagaccagcctgagcaatacagcttgtccccatctctacaaactaaaaaaattactggggcatggtggtatgcacctgtagtcccggctactcgggaggctgaggaaggaggatcacttgagcctaggagtttgaggctgcagtaagctgcactccagcccgggaaacagagtgagaccctgtctctaaaacaaacaaaacaaaacaaataaaaatcagttttccatgtgatcccagcagctcagctctctgtgctttttggtgtgcaaacattttccaaagaggcataataactactgcaggatgagcctaatcacagggcaggctttcttgttcaaaattggaatggggggaggaagcagaaacaaaagcattaattcaggcccacgaagcctaggcttaaagagcaatccatctgcctcttgagcttgaaggcctgctctccagagggaatactcacacaaagtgagtctcatgggaggcacctggccccttggaggtcctgccagcccaggaaataccagatgggccgccaagctgcagatgccccagggaggcagcacagggctgggggtgctacgaaggcctccttccccggcttggctggaaccccgccgccccacccaacccctcaggggcagatgctgggccggagcctctgtgtgctggccctgtaacaaatgccactgaaagccctaccttgtcatgtcttagccacagggacgcacacagagaggtggcgggggctttgcagtctggtaacaagccccaggaggacagctggtctccctattgctgaacacaaggacatcccatcacaccagcggaatgtgccacttaaattaaattttctcccaaatggctgtggttcttcccaagataaaatttatcttcttccctcttgtgcttaggaagagagaaaaatgatcgcagtacctggctggcttccggacttcctaagggtcaaataaaagctctttccatgacacactgacaggcagccttaaaccagcccaagttataaaaacactctgcctcttggagccccaggagtgcgaggacagacagcagcaggctggtggagcagcctcagagggtggacaggcctggctggctgcagcccctcccccagggcccagtgtgtgggctggtcagcccctgagccagcctggcagctgcaggagaggctggccccatgctctgtaaacccccacggggacctgggcaggggctacagagctggcagcaggaacaggcagaccctggttgtttccgggaagcagtacctccgttatcggacctgagaggaggctgcggtctcattcacgccctcggccccatcccagtgttgccagctcagagccctgctttgcagaaagcggacctacagacacagcaagagggaggactagaatagagggaccacaattccctatattggggttagggcacctgagctccaaaacctggcactgagggagaagacgaagcccagggccgtgggtgtgcaagaggcagagacaaggcacactggcggggcccaagtccctgccgggtgcggaggcttcccggtggaggcagccctccaggtcaggaagtggcaggaagattgtgcggctgtgggactggagttggagctcagctccttggccccccttaattgccaggcccctctgggcctcgggctcctcttggctgcacttggatcccgacccccagtgcctgcctctgtaaaggagctccccggtgtgggctcaccatcctcgccttccacattcctccacctgccgggggcttgctctgtggaatggaaggtttggtttgcaaggctgcatgccccctctgagcctagtcatttggggtcacgtgcccctccgcacccctgcctccctgcagtggccattgttcccagaggggctccactgcctgcccagggtcactgtacctccccagaaacctcctctcttcttcaacctgtcttgcagttccagagaaggaaagacacaacacagcagaaaaggcaaacgggctggcacaaggcgggcatctgcatggcagaggcggagcaggagccgacctggagtccttcccagggtccccaccaagactgggaggacagtcccttgcgccagggcgtggctatgggagtggggcagccagaacgtcccccgccccaccccagtgcactcaagggtcctgctcacccacccacaagctcacactgctttttcaggagttttctgagttttctgcacgtcttcctcaccctcctaggttacaaaccaggtgctcagcccactctggtcaacaggtatggccccattttgccagcatatggctgtttagtgaagtgcactgtttaattctgtctccccttgactgagcttggacacgatccccctgcctctgccatctgtccagccctgggctccctaagacctggatgcaaacaaaggaggaagggggctcccaacttggggcccgaggtgcactgtgatgcctgagtggcctctctggggcaaaagtggcatggtacgaccttgcaggctgggtcccaggccccactgtgggcaccactcgccagatctggagctcccggcagtgggccccacacagacgtgcgctgaaaggagttcctggtggcagcctgtgcctgtagtagagagggacgagggaggcctcgtgcacgccgcagagcccaccgagggcctggggccagggggacagggagcctccttggtggaggagccaaccaggggacagagtgcccactgcaggaggggcactgtgatgccaggcaccgtgagttgcgcacctggcctccaggatgggaccaggtagaaatgtcccacccgactacgggaggcactcaggggccaggggagcagccccggggtccatattaatttcagctccattttaaaggcgagttaaaataaacatggggaatatttataaggcaaataaatctggcagaaacagcccctccaagtgtgagtggaggcctcccctcagccccagcccaagctgataaaatacagaaatgctactgtagaccctccgggcttattttgactgcagcagaggaatgtaacatgtaaacactgactcccatattacactgttacaacttgcattaacagcgccggacaaaagccgcattttcacagaagcatcgtacagggatatatctccagcttaatttttaaaaaaaccatttcctcacataaatcatgctcagaatgaaacgggtgactgatacattgcaaacactttttttcttaaacaataacatacctagattccttctaaacgaaagagctttaaaaaaaatcttctaaatgttttttttctgaagaaaataaacactgcagtttcttttctgaacaaaatatctggagctgtgtcttcccggccgagccagctgcccccagcacagggttgcagaggagcgctccccaagccccagccaccttgctagggagacagcaaggccagggcacccagagcaccgggccccctccccaggcccaagcgggcagcctctgaggggaacaggcacaacgagggtggtgaaagtgctgggctgcagtgaccgtcaccgaagaccccagtacatcgaggggcccagcagacatcctggggctgccagacatccaaggccatttccctgaaggtccagcagacaaagcatcctgcaggggctggaggggcatccagactccacccagagaagcctacgtgaaagacaaccagaggcacaggcagaactcaggacgccgagtgagaacagtgcctcgagatgggcactggggcccgggcaacccatctccaccacaccgcagaagaagtgcagccagcccaaggaagtaaaagaaaatccgacttgtggacgcccataaggaaaatacagggcttaaaaaaaaaaaaaaaaaatcttgggggtggggcaggcctttctgaacatgcaataaatcaaaaagccactaagtgtaaaagatttaagttacattaaaaaaaacttaaaccatttgtacatcacacaagttaaaagacactagaagctgagaaaatctgcaccacaagcgacagaggatcacatccctaatacacaaaccagctggagggtaagaagagataagagaagagaaaagccagacgtgaaagtggacaaggaccatgctggcgatttgtgcagcacacatgggcatgctcacagacacgctcatctcaaatgaggctgtgacacgaggcttttcaggtaaatgtgtgaaaagaccactgatcacagcaaatgcaaacagagtcagatcatgtgtaactcagcagatagtcaaagattaaaaaaacagtctgggtgccgtagctcacacctgtaatcccagcactttgaggggccagggtgatcacttgagcccaggagttcaagactagcctgggccacatagcgagtccttgccctaaaaaaaataatcattagctgggcgtggtggcgagcgcctgtaatcccagctactcaggaggctgaggcaggagaattgcttgaatccaggagatcaaggctgcagcgagccatgatcgcaccactgcactccagcctgggcgacagagcaagaccctgtctcaaagataaaaaaacagataacccagaaattatggcataacaggaaaaagtgattggtgtgacaacagaaaaacttaaaatttctgcatgaaatactatcaccaagtccaaagacaaaccacgatcagtgggtccaatggaaggcagcaggcagtcgatggaaaccagcacaagctcagcacagtctcaggagagtgtgggcgccgtgggtagcagtgaccactctcaggagagtgtgggcgccgtgggtagcagtgaccgctctcaggagggtgtgggcgccgtggatagcagtgacggctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgccgtggatagcagtgacggctctcaggagagtgtgggcgccatgggtagcagtgacggctctcaggagagtgtgggcaccatgggtagcactgaccgctctcaggagagtgtgggcgcaccatgagtagcagtgaccgctctcaggagagtgtgggcgccgtgagtagcagtgaccgctctcaggagagtgtgggcgccgtgggtagcagtgaccgctctcaggagggtgtgggcgccgtggatagcagtgaccgctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgctgtgagtagcagtgaccgctctcaggagagtgtgggtgcaccgtgggtagcagtgaccgctctcaggagagtgtgggcgccgtgggtagcagtgaccgctctcaggagagtgtgggcgccgtgggtagcagtgaccgctctcaggagtgtgggcgccgtggatagcagtgaccgctctcaggagagtgtgggcgcaccatgagtagcagtgaccgctctcaggagagtgtgggcgccgtgggtagcagtgaccgctctcaggagagtgtgggcgcaccatgggtagcagcgaccgctctcaggagagtgtgggcgccgtgggtagcagtgaccgctctcaggagagtgtgggcaccgtgggtagcagtgaccgctctcaggagagtgtgggcgccatgggtagcagtgaccgctctcaggagagtgtgggcgccgtgggtagcagtgaccgctctcaggagagtgtgggcacaccatgggtagcagtgacagctctcaggagagtgtgggcgccgtgggtagcagtgacagctctcaggagagtgtgggcgccgtggggagcagtgaccgttctcaggagagtgtgggcgccgtgggtagcagtgaccgctctcaggagagtgtgggcgccgtgggtagcagtgactgctctcaggagagtgtgggtgcaccgtgggtagcagtgaccgctctcaggagagtgtgggcgccgtgggtagcagtgactgctctcaggagagtgtgggcgccatgggtagcagtgaccactgcccaggccaggggtatgggaggagaggctcctttctgttttgtgtcttatcaaaaagctgatgcctgagttaccaaggacagggaagcaggcagagtacacatggaattggcctgtcagcacaaagtgttaagacggaagggcagctccccttgtaaagcgtataagaccacctcacagccactaggatggccactgtcaaaaaaacagaaaacatcaagaaaacagtttaaaggaaaaaataaaaattaaagaaagaaaaacagaaaacaacatgcactggcgaggatgtggggagcccagagtcctcctgaactgctggtgagaatgtaagatggtgtgggcgctgttgggaacaggatggaggttcctcaagaccataagatccagcaatcccacttctgggtttgcatccaaaagaactgaaaggtcttcaagaggtatttgcacacctatgttcacggcagcactgctcacaacagccaagaagcagaggcaacttgggtgtccactgacagatgaatggataaacaaaatgtggtgtgcctgtacaatggaatattactcagtcttaaaaagaaggaaatgcagatacaacatggatgaaaagagttccagacatggatagtggtgatggtttcacgacattattaatacatttaataccattgaactgtatacttaaaaatggttaacgtgggctgggcgtggtggctcacccctgtaatcccagcactttggaaggccaaggcaggtggatcacctgaggtcaggagtttgagaccagcctggccaacatggtgaaaccccatctccactaaaaacacaaaaaattagcggggtgtggtggcagacacctgtagtcccggctactcagagggctgagacaggagaatcgcttgaacccgggaggcagaggttgcagtgagccgagatcgcaccactgcactccagcctgggcaacagagtgagactctgtttcaaaaaaaaaaaaaaaaaaggttaaagtggtaaattttatactatgtctgttttatcacaatgaataattgggaaaatgtgtcagaagcacttctgatggtaaacagatgcacctccaaggttttcactgcagcattgataatgatgaagaagagaaactactgagatgctcattaacaagagaaaggtcaaaggaactataccacatccattcaagggaatccagtcctgaccccacacaaagatgccccgtgaagtgtgaaacaatgacaagcagagcatgtgacacaccactcacacacacacacaccactcacacacacacaccacacacacacataaccactcacacactactcacatacacacaccacacacacacaccacacacaccactcacacacacacaccacacacaccactcacacaccactcacatacacacaccattcacacacacaccactcacacacactactcacacacactgctcacacacaccacacacaccacgcacacacaccactcacacacacaccacacacacccacacccttcacacacacacaccacacacaccacacacacaccactcacacacaccactcacacacacaccacacaccacacacacccacacccttcacacacacaccacacacacaccactcacacacaccactcacacacacacacaccacacacccacacccttcacacacacacaccactcacacaccacacacacacaccactcacacacacaccacacacaccattcacacacacacaccacacacatctgcacgcacaccatgcacattcgggcacacacagaagtgggacccttttccactgatattttctcctggggaaggctcgagactgctattgaccaagcctctgccgccctctggtggtctctctgctccctgccaacatgaagtctccacaccccacaggcaggagctgcctggacctgggacctcgggatggcccactctgtgggcatcggaatgcacttagtgactctgcacctgctcccatggggagtgagagccacttgcacgctgctagcctcccttccacaatcaagatgttgtttctgaggcctttggagtctttgctagatttcagggaaacccaatgtacaaatcagaagacagtgagggtgttagatgagggctgggatagggattgctggctctcccctccttaatgttctccctgatgtccttgaggggacccactggaaccccagggctcctgggaaccccatttgacaaccactgacctagataacaaacagctgactccatttatatggcagtcctgttattgttattacctccaaggcagccacaggacagagtaaatcaacagccctgcagaggggcacaagtcacaggtttattgtttagttttgagacaaggtctcactctcccaggctgagcgcagtggtgcaatcacagctcactgcagcctcaacctcctgggctcaagcaatcctcccacctaaagcctcccaagtagctgggactacaggtgcacagtactatgctcggttaatattttcagatttttgtaggctgggtgtggtggctcacgcttgtaatcccagcactttaggaggacgaggtgggcggatcacctgaggtcaggagttcaagaccagcctgaccaagatggtgaaaccccatttctactaaaaatacaaaaattagccagatgtggtggtgggcgcctgtaatttcagctactttggaggctgaagcaggagaatcacttgaacctgggaggcagggattgcagtgagccaagattgggccattgcaattcagtttgggggacagagtgagaattcacctaaaaaaaaaagccaaaaaaaaaaccaaaacagatttttgtagagtagaggtctcactatattgcccaggctgatgctgatctcgaactcctggcctcaagcaatcctcccgctcagtctcccaaagtgctaggctaacaagcatgagccaccacacctggccacaaataacaggccttttttccttcttttgggtaaaccggaaagaaagccccaggagcccagcaccagcacaggctctaagggtccagtgctcactctggtgaacaaaaagaggaccccaccaagcacgcgcaggccttacgtttttccaggggattccttcagccagaagatgtcatcacttgtgattccatattccaaggcaccttcgatctgtcaagacagaaatgaccccttggacaagagctccatttggcctgtcctagggcttccttaaagaggatgccagctttgcagaatcaagcagagctttcccagggcacacatgcacagggcttccctgctgccagtccttgtctgcaggctgtggcctctttggggctgcaggtggcctgtctgcatctaagctgctgcactccaggtcccggtgccctcgcagggtacctttcccctctgttccccaggaccctccccttgaccctggttcagagcaggatacagggcctgaggtgggtacagcaactgcaggggccatacaggcagacagctgggacccctcaagtctgcccgggttctggacagacacatcaaacagacaggggcatgcagccccagggagcaacacctgggttctgggggatccaaactcagagagaggaagtggggagagaacaggtcagcaaatcagggccagcagagctcaggtgtgtctgcgcggcaggggtggcctacaaggccagccagaggagaggaggcacagggggtaagtgccacaggctgaggtgggcagggactgaggggcagctctgagggcacctggctgaagccaggacggacttcacactctcgagggctggcccgggtgggctctgagcccagaaatcatacaggtcacctgaagaggggcggccaagcaggtgggaggcccagggtgaacgtccccttagcggccatgagaacaagatgtgctggtggaggaagcggatctcaaacagtttatgcttccaactggcaaaaaaaaataaagtcaggaatttctcaggtttactcaaggaaaaccgaaaggtctggcaatcaaagggactaaaacgcaagcaagccttggcagacaccctgggagggcgtggcagggagagcgaagcagccctgagctgcctgcctcctaaggaccaggagcgcctgctggatcccctgtgagcccaaagagccgtcagcagctgcccgtgaggtgcagagcagggccgggccaggccagggcccctgtgcagtgctccctggtgcggatgcacgtgcagctctgcctggggcctcagagaaacccaatgaccgctgggctgctggaagctggctgtggccttctttaagcagaaccaccatgagcccagctgccaggagaggggatcactgggaccctgtctgcagcagctgccttgaacaactgcacagtgtcatcctacaaagtcacgcagccctgagccccacctctgtgcataagcaacctgccccctctagaggctgctgtggctgcctggcggccagacaagtcccacggcctctaaggactgggggtgcttgtgctcctcggggccgctcctttccctgtttccacagtaagcacaggacgaagtggaggctggggtcacatccaagaagtggcagaacctccccttgctctgcctccaccggactgcccctgggtctaagtcagaggtggtgtggcctccaggccgagagagccgtggtcttcaagagcttggctgcagcctacttagaggcttggagcaggcggcacacggttccctgggagacccgtggggactggtctcagccaaacctctctgctcacccccagcccatttgctttccctgctgcagctgccccccaacccctcaccccggggccccttcctcaactctgcccccacaacccacaagactgggccaggagttattcacctctctgttaaaaacagcgataaaactggcaagaactgggagattcagaattatggaaattaaccacaggcttgcagcaacacagggaacatttaaagtcaggaaaaacagctgaagctgagtgagaatgggaactccagggtgttttaactcactctggtcccactcccacctcagcggcagccctgaacagtgatgtgtcagagagagcagaactcagctggggtctttcaaagcccccccacaaagaagagtcagagtcagcaactatagggtcatcttcatccaacttcaccggagctcagccagggctaaaagcctttctctgggggcatttgtctgaggttttcttctcacagctgcctgaggggataggtaacagttagagccaacaacagactgcccaaaaagcttcaaaggaaaagccaaagtatgagatgtctgctggagctttgaaaggttccagcatattcctgggaacctaggccaggcgcatgcacagcactgtgcacacatcaggaaggaccaacgaggccctgaaccctcacctccagctgaccttgatctctgcagaagcaggaagtgaaggctagggcagagctgtctgctgcctgttgagtgtggaaggcatcccctccaaacgcacacagagccctcagcaaagaccgggagagttcttagtttagggaaatctccatgcagttcttagctgaccactaagctaaccaagtaaagacttcagtggccacatacatcaaagaataagagtctacaaagtcagttccgaaaagtcaccaaataagcagctgtaacaacagaatcctggggcagagggagaatctggtttccaaagttatcgcattaaattatttgaaatgttcagctttcaataaaaaaattacaagatacgtgaagaaacaagaaaccatgacccttacaccccactggaaggaatgtaaaacacagtcattgtggaaaacagtctgaggttccttgaaacgttccttgaaagattcaacataaagttaccacatgacccagcagttctgctcctaagtgtaacccaagagaagtgaaaactgaagtccaccaaaaaacttctttgcagatgttcacagcggcactattcataatagctaaaaagtggaaataacacatgtgtttatccaagcaagtagataaacaaagtgtggtctatccatacaatggaatagtatctagccataaaaaggaatgatactgacacacactacaatgtaggtgaacctggaggatgttatgctcagtgaagtaagccagtcactaagggacacacacatacgagtcactaagggacacacacgtaccagttacatgagaaggacttacatgtacgatttcacttacacgaggtgcctagtgttgtcacattcatagagacagaaagtaggtggtggtttctaggggctgggggaggaggcgctggggagtagggtttaatgggaatagtttcagttcagggatgatggaaggagttctggcaatggatggtggtgactgatggccgcacagctctgtgaatgtactaaaaaccactgaattgtaccctaaaaaaggctaaattttatagcgtgtgaattttatttcaaactttttttaaactgggggacgtgaaggaggaagatgaagaatgaggcttatatcctgaatgttccaacattctgaggctgaagggaaaagggggaatcagcaatggagacttaggaagcaggatcctggtgtggaaggggacagatccagcggggcagggggagagcagaacgagagctgtcctgaggatctggcagcgtggaggccactggggaccccacatttcagcagtgtggattcaagagaattggaaagcagaaagtgatgatagtgagtatagggggaaagggtgtgcaagctgctgctgtgggaagcacgtgtgtaaaaacgtatccctcaaagaggccgggaatgggccacggcagcagggacgctatgctctggggacactcacgtgcgtggggtatctcggccgccctccagtagcaatgatgatgtgatcggctgacagcagaatctgaggagaaaaagagaaagccgtgggtcagacaggtgcatggtgatcaccccaccggagggcctgagcaccacagaccttggccagcagttcccacggcccctgccctgtagcgtggacccttggccagcagttcagaggccctatggagctggaatcccatcaaccatcagcctggcaggagggggacaggcagaaagcacagggagatgttctaactccaagcacttcaaggcaccctcaaatccccaaaaaatcctgcaaaaagggtgtggtcaccaaccctgttgccatgccactccgagcagcagggcagcaaattatttgatcacgttaaagacaagtgcccagcctcaaaagaagccacctttttgattccagcagcacgtgttactaagaacagcacccaggccaaacacagctgcagttggtgcccaaggtctgcagaagggtccacaaggagccacgcgagtaagtcagatgctcacctctttcccacctttggcaacgccgcaaaccgtgtgctcgtcaacaaagctggctttgatgttaaagtacttgacttttctgaaagataaagataagattttcaaacacttcctctgcaaattaaacctcaccaactggatcaatagggaacactggtaaaagggagctccagcccccagcagggcctggtgctgtggctcagatggaccaagaggtaagcggcaaccatgctgagaagcatggaggggatgtgggggcacctcgcctgtcccccagggatcccagggacatgttaaccacaggtgtcaaagcagggacggaagccagctcagcacggtcctaagaggccacgtacagccctggtgtgcagcaagaggtggctggacctctcttggggacagtcctcatcacccggacatgttccagcagggagctgtggtgcccaccagatggtgtcaccttctgatttcaggggtgtggtaacaccaagagaacgggcatgacaaggctggcaaaacagtggctgggagcatagtgcacagaaacaaatgacccacgctttcttttcttttttttttttctgagtcaaagtctcactctgtcgcccaggctggagttcagtggcacgatcttggctcactgcaatctccacctcccaggttcaagccattctcttgcctcagctcttgcctcagcctcctgagaagctgggattacaggcttgcgccaccacgcctggctaatttttgtatttttagtagagacggggtttcgccatgttggccaggctggtcttgaactcctgacctcaagtgatccacccacctcagcctcccaaagtgctaggattacaggcatgagccaccgcgccccacccttttttttttttttaaagacatcttctcactctgtcacccaggctggagtgcagtggcatgatcatagctcacggaagccttgtttcaagtaactggaactataggcatgggcaaccatacctggctagttcattttattttttgtagggatgtagcaataaaactatgttgctcaggctggtctccaactcctgggctcaagtgatcctcccacctcagcctcccaaagtgctaggattacaggcatgagccactgcacccgaccaacactttctaatgacaaaaggaccgtgctgcagcaagggttctgggaaggctctgcctcctgcttgagcctgccttctccccactggcaagcctgtgcctctatgggctgtctgagctgcgtgaagttcctacagcaagagcccttcaatcacctcgacagccaggaagctgccacgggacacagccgggcaatgctcatggcagcacttttcagaagagtgaaaaagcagaaacagcccaggtgcgccccagcctccttctgcaggtggctccggagcaggcagtgggctgggcctgtttggtgcccgtccaggagctgcccagggcagggaggagggagggcagagcctgctgtccccaggaaactgtaccaggggatacagagccccacagagaaacacagaaatgccacagcacaatgtggcttagctccctggataggggagagcttgtgaggtccaggtggagggcaagcagttggcttcctggctccactttcctggatttagtgagcacaaaactgctgcctgctgtgaagccccaggaagacccgccctggggccaagcaaatggtgcatgaggagagccaccagacctctgcgggaccactgtcccctccacagccccgggagaaaggctgggccagaggcggtaccagtttcaggcatctgctgtgctggcagctgagccccaggagaaggttgtaggccaggggagcataggcctctgtgctggagatccccaggggctgacaggaacggtgaccaagtagggacatttgctccagcggaaagcaccaagctcctgcacccacacccaaggagctggaggtgtgcagtaagaagggggttcacggggtgggggcttgccactgggatgaccctcaccacatattagccccaggcctagctatgtccacgctctctggcctgaggccttccagccccaagcgcctcctccctgtgcagccctgggctctggccattctgccaatgtggcctcactcattccttggcagcacctccaggctctgctcagcagcaaagggcagtctccccttcccctacagtcactcccatctgctccttgtcctcatccccacccatgagcaggacatgaacccccagagcctgccagagcatgctctgcacagtaagtaagtgtgtgtccaggcacagaacgcccaagagaaggcccagagggcggcccattcccggagagagcttcagtacctgtcctgaagctggacacggtggccccagttcaaggatttcacgtgattttgaacagcttctgccatcttcctcctgtgaagatacgaaacaaaatgtaaaatccacaacacaggtgttagctgcagggcctcacgatggactattagattcaaatggtacattcatagaaatatcaaaaaacaagagtgcttttaaaggtggcaaaacgtgacatccatccctacgtgcaaccgcctgtcccaggctcagggctgcagacctttggactcacagaaaacaggggctctgacccacggctctccagatgcagctgctctgtgccccaaaggctacccactgcaggcagaggcctatctgagccaatgtgggtgtggctgggccacgtggtccccttcccagaagagctcagctgaagcggcctcccacccgcactcctggccttggagatgcactgttcttggtggggctgtgctgtgcatggctgtagcatccctgggctccccgcaaaggggagcaaacccttccccagtgacaaccaaaactgtctccagacattcccaaatgtctgaggcagacagcgcagagtcgcccctggctgagaaacccatcctacggcccactccccatgagggctcatcgaggataagcctcctcttcctcttccacccaagagtagaagaaaagcactggaatgccacggcgccagatccttaccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgcctgggacgtgggaagagcacatttgaatttatgttcaggtgactgctggaggcttccctgttcttctagagtgtttggaattccttaaagttgctttgtaactctaacacagaccagctgacatgccacacgaatctgctctctataactgtactcgaaaataaaaacagttgtttttactttttaatatttattaatttatttatttgagatggagttttgctcttgttacccaggctggagtgcagtagtgcaatcatagctcactatagcctcgaactcctgggctcaagtgatcaaggcctgccttggcttcccaaagtgctgtgagtacaggcgtgagcaactgcacctggccagagttgttttcgataatggtcaagaactttaaagtaatgatgagtgaaacaggacactgtccagaaaccatggacagcagggctgaaggactttggtgtcagctgccctctgtacaggaactgggcccacctcccacctccttccccaggacacccggctcccatagggtgctgcctaccttggggagaaggttccacgtagtccaccacggccaccttccttcccagctgggcggctggaaggataaggagagcagcaggtgagcatggggagctggctcaggactcaagaacaggcactcctcagggcttgtgaggtccagaagagtgtgggcagggcctgggcctgcggctgcccacacagtggctgagctgcgcaatgctagggacccctgatctgcctctgcgctctggcctgctgagctgcgctgcctgctggctctgcattgagtcttccagtctctttctggcactgcccacccagctgcgctgcccacaggcaggagccctcagacctctcagggcccgcagcctttgtaccatccacccctcacagtgctggcatcagccccacctgcccctgcatgttcacgttcaccataagcccagtgcccacccaagcatccctgggtggcatcccccaggtagccactcaccgggaatggctcctgactcagaggctctcccttgccccttcccatcccagccagagccccctaggtgggcattcgctgcctcactctcaggaccaggacaccaaagctcaggagaagtgacgcagcagccccagggtggaccagccccagagcaggagccgagacctgactccaaaccacacttcccgctgcagagccacccagttgccctcccagccagcagtgtggccacccagggccacaggttctggggccaactcagaaaccattagccaggaccgggcatggtggctcacacctgttatcccagcactttgggaggctgaggaaggtgtatcacttgtggtcaggagttcaagaccagcctggccaacatggtaaaacgtgtctccactaaaaataaaaattaaaaaattggccaggtgtggtggtgcaagcctgtagccccagctacccgggaggctgaggcaagagaatcgtttgagcccaagaggcagaggctgcagtgagcagagatcacaccactgtactccagcctgggcgacagagcaagactctgtctcaaaaaagaaagaaagaaaaaaaaaaaaaaacattagctagggctaatttcaagcttccatttgcccgggcttgggcactgcatcagcaaacttcaggccttggacttgactgcctcccaaggcacacacaaatctcatgaaccctaaaatgccaaggaaagtgtttgattcgtggctattagaaagcaagattagaacaaagttttgtaagagttcatttttaaaatccattttgcttggctgggtgcagcggctcatgcctgtaatcccagcactttgggaggccaaggtgggcagatcacgagggcaggagatcgagaacatcctggctaacacggtgaaaccctgtctctactaaaaaatacaaaaacaaaattagttgggcgtggtggcaggtgcctatagtcccagttactcgggaggctgaggcgggagaacggtgtgaacccaggaagcggagcttgcagtgagccgagattgtgccactgtactccagactgggtgacagagcgagactctgtctcaaaaaaaaaaaaaaaaagctaatgtccacaaggcacagtggctcacgcctataatctcaacactttgggaggccgcagcaggcagattgcttgagcccaggagtttgagaccagcctgggcaatatagcaaaaccctgtctctacaaaaaatacaaaaattagctgggtgtggtggcatgcgcctgtggtcccagctgctcgggaggctaaggtggggggatggcttgagcttagcaggtggaggatgcagtgagtcaagattgtgccactgcactccagcctaggtgacagagcaagaccctgtctcaaaaaaaaaaaaaaaaaaagccagtgtgccagtgtgtaactcccacatctgaccacgatggagcagcagggcccagatttaccctccccctgaagcaacccaaaacccaggtaaaatgcatgaaacaacgggctttcaggtactccatgtcaggtaacaaaggacctgagagagaggaaacaaacatggtgagccctggggagtctccaggacccagcactgcaggctggggaagatggggagaatccagcacaggagagggctgagaactgggggagactgaggcagccagaggtcatgcacagaagacagtgaggagggggctgcccagagaatctgagagatctgatcggcgcatgtgtcttgggaaactacctgagaccagacagaaccacctggaaggactggaggggacagagcccacacagggcaggggacagtgcctgttcccagaatctggactgggaaaagcatataattcctggggcgttgggtcatgccccagtagttgagaatcattagccctagactgggcactgctccatacccacctaacaaatcttttgcagaagacccaaaaggatcaaactgactcttaataactgcatcccagaacagagctcaataatagtatttctagaaatacaaaaatgcccagaacccaacaaggtaaattcaagtgtctggcattcaaccaaaaattaccagtcacacaaagaagcaggaaaatacacctataaaggggacaaaaaaaaatcagtcaatggagactgacttggaacagacacagatgtcagaattagcagaaaagatcaataaaacaggtattctaactattccatacttttttatttttatttccttgcttagatgcctcacttgtgtgccctaactccaccttatcacatatgatgaactatctgttcatgtgtctgtctcggtaactaaactgcagaactccgtcagtcaggggctttggtcctggtttgtctttgttgttccgggtcctggcccagagcttggaccacattaagtattcaaatggtttgttgaagaaattaacatgttaaaaacaaacctttctcacagaacactgttcctccttcagtgttcaagatcccagacctttgggtccctttttacctacttactccctaccaaaagttctctctccttcgactccagggtggttttataaacctcttatgcatctcaacttgcactatatggtagctacttttcacagctacagacttttggtgtgggaaggatctttttttctctttttttgagatggagtctagctctgtcacccaggctggagtgcagtggcgtgatcttggctcactgcaacctccacctcctgggttcaagcgattctcctgcctaagcctcctgaatagctgggattacaggtgcgcaccaccatgcccggccaatttttttgtatttttagtagagatggggtttcaccatgttggtcaggctggtcttaaactcctgatctcatgatccgcccacctcggcctcccaaagtgctgggattacaggcgtgagccaccatgcccggccaggaaggatattatatgcaatttgttctacctgcttacctgaagtttgagtctccttcataacatcctcaccaagtgttcacctatgcctggtgcctttgtctgggaatgtattgccttcccaagtggccatttaattttgggaactctcccaatataaaatttctcctcatattaattggaaatgttttcctataactcttaactatctccaccccctctcccacatgcccactctttaaaatttaaaactatttttttcctttcccttaagttttctctttttgaattccttcaatgatgactttcaaggatagattccttcaactaggatagtttaggtcacttctctccaaatgacccaccttctccaaacctctgttcagaaggggctgcgatgctcccagtaggaagtctgaggccctaaaaatgggcagctctcgacctgtcctggctctgggctgtatcagccttgaactcggtcacatcaaacatctgacttatagaagttaacaagcagactgggcgtggtaactgacgcctgtaatcccagcattttgggaggccgaggcgggcagatcacctgaggtcaggagttcgagaccagcctgaccaactgtagtttcacgaccagtagtgaaagctcgtctctactaaaaatacaaaattagccaggtgtggtggtgggcgcctgtaatcccagctactcgggaggctgaggcagaagaactgcttgaacccgggaggcagaggttgcagtgagccgagatggcaccactgcactcaagcctgggcaacaagagtgaaactatgtctcaaaaaaaaaagttaacacagcattcactgaaacccctgaggcttttttttttttttttttttttcaaatcttgtggacttctgactggtacaactgcagctgccttgcctggtaacttgggtacctggtttgtgggtccaactgcaggccattcaggtagacttgattttttttttaatttaaaaaaaggcttttttttcttttttcttttaaagagacagagtctcactttgttgcccaggcactggtgtgcagcggtgcgatcacagcttgcttacgccttgacctcctgggctcaagcaatcctcccagctcagcctcccaaagtgctgggaccacaggcacacaccaacgcccagccctcagtggttttgatggattagtgtatccccagaccctccgaaggggaggacagtgccttatctctctctttcttccaccaagaaggccacaaccggccttttaaccttgatccaagcgaggctgaaaagcaaacagggcgttcatcttcatcctttatagccacatagccacatctcccgcccacaagcagattccaccaccccccgcaccctaaggcccagcctcatcagctgcagcatcttcacctggcctttcacactgaagcagaaggggtgacggtttactttcagctgcatggtctccatcatacccgtagacccaacagctgagcttcccctctgtcccttctcctcagctcactgccccactagccattctgcatgttcaaacagtgcaggagcaacatggaagatataaccaaaggctcaagctggattgtagagatgaaaactacaatacaggagatgaaaaatacactggacgggattaatggcaggtcagatgttgcagaatcttttattggtgggtttgaaaacataggaatagaaactatccaaaatgaaacgcagagtaagaaatgtttctaatgaaaagagcatcagtaggttgtggggaagcttcatgcagcctaatatacatggaattaaaagtccccacatgtgaggggaagaaggagggactcaaggccaatgaaaagagaaaatcctaaaagcaaccaagacacactacagagacactaagataaaaatagtagcagatttctcactggaaacaatgcaagccagaagtcagaggggcaaaatttttaaagtactgaaaaaaaaaaaaaaagcggggggccaggcatggtggctcacgcctgtaatcccagcactttgggaggccaaggggggcggatcacaaggtcaggagatcgagaccatcctggctaacacggcgaagccccgtttctactaaaatcacaaaaaattagacgggcatggtggcatgcgcctgtagtcccagctactcaggaggctgaggcaggagaatggcgcaaacccgggaggcagagcttgcagtgagctgagatcgcaccactgcactccagcctgggcgacagagcaagactccatctcaaaaaacaaaacaaaacaaaacaacaacaacaaaaaagaaggcaaaataaagacgttttcagacatacaaaagctgagagaattcattacccccagagccatattacaagaaatgctaaaggatgcccttaaggtagaagaaaaataccagatggaaatgtggatcctcacaaaggaatgaagagcacagaaatacaatgggtgagtatgtgagattttctcacacgatttaagtatattttaaacaaaaataataatgatgtatcatggatttataacatgtaacagtaaacacatgatataataacatagaatgaaggttaggaggggtggaatagatgtatgcttttttaagggtagactggcaagttaaggtacatgccataaaccctaaagcaactcaaaataaatcaaagacctaactgtaagagcttgaactataaaatgcttagaagaaaacacaggtgtaaatctttgtgatcttggatttcttagctatgataccaaaatcataagcaacaaaggaaaaaaatagataaattaggacttcaccaaaatttaaaacttttgtggcacaaaggataccatcaagaaagtgcagggccgggcatggtggctcacgcctgtaatcccagcactttgggaggccgaggcgggtggatcacctgaggtcaggagttcaagaccagcctcaacatggagaaaccctttctctactaaaaatacaaaattagccaggcgtggtggtgcatgcctgtaatcccagctactcaggaggctgaggcaggagaattgcttgaacctgggaggcggaggttgcggtgagccgagattgtgccatggtactccagcctgggcaacaagagcgaaactccgtctcaaaaaaaaaaaaaaagaaagaaaaagaaaaagaaaatgcgaagaggccaggcacggtggctcatgcctgtaataccggcactctgggaggccgaggtgggcggatcacctgaggtcaagagttcaagaccagcctggccaacatggtgaaaccccatctctactaaaagtacaaaaattagtcgggtatagtggtgtgtgcctgtggtcccagctacttgggaggctgaggcaggagaatcatttgagcccaggaggcacaggttgcagtgagccaagatcacaccactgcactccagtcagggtgacagagcgagactccatctcaaaaaacaaaacaacggcggctcacacctgttaatcccaaccctttgggaggccaaggtgggtggaacacttgagaggtcaagagttcaagaccagcctggccagtatggtgaaaccccgtctctactaaaaatacaaaaaattagctggatgtggtggtgcacacctgtaatcccagctactcgggaggctgaggtgggagaattgcttgagcccgagaggccgaggttgcagtgagccgagatggtgccactgcaccccagcctgggcaacagagtcagaccctgtctgaaaacaaacaaccaaccaaccaaaaaacagctgaaatgtccagaacagacacatccacggatataggaagtagattagtggttgccaggggctggggagaggggggaagagactgactgccaatgggtacagggtattttggggagaaactaaaatgttcttgaataacacaggtttgaactgcacaggtccactcatacatggattttttttcaataaatataatcccttgaccgggcacagtggctcccacctgtaatcccaacactttggaaggccaaggtgggcggatcacctgaggtcaggagttcgagaccagcctggccaacatggtgaaaccccgtctctactaaaaatacaaaaattagctgggcgtggtggcaggcacctgtaatcccagctactcgggaggctgaggcaagagaactgcttgaatccaggaggtggagagtgcagtgagctgagattgtgccattgcactccagcctgggtgacaagagcgaaactcggtctcaaaaaaatatatatattatctctccatatcagcaagttccaaatctgtaaccaaactcggattggaaatacagtactccactggacatggtggctcatgcctgtaatccagcactttgggaggctgaggcagacggatcacttgagctcaggaattcaacaccagcctgggcaacatagcgaaacccaccttctccaccaaaaaaatacaaaaagtagctgggcatggtggcgcctgtggtcccagccactcgggaggctgaggtgggaaaatcgcttgaacccgggaggtggaggttgcagtgagccgagattgcaccatttactgcagcctgggcaacacatgagaccttgtctcaaaaaaaaaaaaaaaaaaaagaaaagaaagaaagaaagaaaagaaagaaaaagaaaaaaacagtattcataggatgcaaaactatatatacagagggctgactctgtatctgtgggtgcttcagggccaactgcctgactccagtatgcacaaatttcagtgtccatggattctgctaacagcgggagttcctgaacccagtcgtcctcgggtaccaagggacaaatgcatacgtaatgtgaggtatatctcaataaaactattctaaaaatatgaaacacttagggatgtatctgataaaatatgtgaaagacgtagacattgaaaaccacaggccaggcaccgtggctcattcctgtaatcccaacgttttgggaggccaaggtgggaggatcatttgagcccaggattttgagaccagcctgggcaacacagagagaccctcatctttcttttttttaataaaaaaaaaaaacttgagtaaaaaagaaactacaaaatgctgctaaaagaaatgaaaaaatacctaaataagagatataccacacgatccagttggtccatttttaggcacttacccaaaataatttaaaacatatatccacacaaacacacagacagacgttcacagcaatactgtccacaatggccaaaaggtggaaacaattcaagtgtccagctacaggggaacacgtacacgaaacggcacagccataaacagaacactactcagcaatgaaaagcaagaaaccatcgacactcgcgccaacgaagatgagtctcaaggtcattaccctgagtgaaagaagccagaagaggaagatgacatacagcagcattccgtttatacgcaattatagaaaatgcaaactatagtgacagacagcacatgcctggttgcctaggatgcagaagtgggggaagccggaaggaactgccaaggtttcagaaaatgttggggtgttatgggctgagccatatcccctcaaaatccctatgtggaagccctaaaccctagcacttcagaatgtgactgtatttagagatagggtcttcaaaaaggtaattaagttggctggacacggtgactcatgcctgtaatcccagaactttgggaggccgaggcaggcggatcccttgaggccagaagttcgagaccagcttgacaaacatggtgaaaccccgtctctactaaaatacaaaaattagccaggtgtggtggcaggcgcctgtaatcctagctactcaggaggctgtggcaggagaatcgcttgaacccagaaggcacaggttgcagtgagccaagatctcaccactgcactccagcctgggtgacaaagcaagactcgcttgcaaaaaaaaaaaagaggtagttaagttaaaatgaggccataggccgggcgcggtggctcacgcctgtaatcccagcactttgggaggccgaggtgggtggatcatgaggtcaggagattgagaccatcctggttaacacagtgaaaccccgtctctactaaaaataaaaaaaattagccgggcgtggtggtgggcgcctgtagtcccagctactcgggaggctgagacaggagaatggcgtgaacccgggaggcagaggttgcagtgagctgagatcacaccactgcactccagcctgggcaacagagcgagactccatctcaaaaaaaaaaaaaaaaaaattaggccatatacaggtacagtggccacacttgtaatagcattttgggaggctaaggcaggaggatggcttgaacccaggagtttgaggttgcagtgagctgagatcacgccactgcactccagcctgggaggcagaacaagaccctgtctccaataaaaagccaacaaaataagagggcatccacctgatccattaggacaggtacaggtagagattaggacatagacatgcacagagggacgacaactgccatctacagcccaacggagaggcctcagaagaaatcagccctgcccgcacctggatgatttctagcctccagaactgagagacaataagcatgtgttgtttcagccgcccagtctgttatggcagtctgtttattacggcagccctggcagactaacggggtggaggacacactcgccaatcttgactgcggtactggctgcatggacacatgcacacataagaatgatcaggttgcccattttgataggtacagttcatctcaaaaaagccacaaaaccacgtcatcctctgcagggaaatgccactctcatgaaaggcggagacatacccaggagctgtccacattccggattaaaggggactcaggtctctgcagctggtcactcccagcatgggagtgaacgcacagcccaggtgcccggtctgctaaaaggaacagcactaggcctcgtggctgcctgcgccatcgtttctgggagtggttctgagagtacagtgtggcactgatcctgggtgcctctgcggatccccaataggccaggagacttcccaggttcctacacactccccggcccccacagagcaagagtagtggatttcttttacaccatgtatgcttctagagcccaatactggacatcagagaagcacagcttcagggccaaagtgcccagttaactccctctcatttcagccccacctccctctcatccccttccctccccattcaccacaactgccctcttatcattgtgtagacatggccagagcagaccaggaactcctacagcagggcacagagtctggcaaagtgctggtggcctgtgcatcacgtgggttagcagagaactgcaaagtgtcatctctggacacctctgggtccagcccgttcgcccaacatctttactcaatgggtgccaggccaagtacaagactcacccagcagaactgaccatggaccctgggggaaggcaccagcactaagaacaaggacagggacaagcaggagggtgcagctccagcctcgcagctagccgggcaggggcagagagcaggcaggcagggtgacagccacagtaaggtgaaggagaggactgtccagaagcacgtgaaggaaagtggggagcccacggagggtgtgagtggtgggagctgagactagtcggattggggctgtcactgtgagtaaagcagaagagctggagggctggagctgaggaaggcagttcagccatgaagtgccacggcggccgctgggtacagcagacagctggagagtggcagggaacaagccacaacacagaggccactggggtgaccccagcagggaggcaacgcattttgctcatggacgttttctggacagcaccaccctctctaggggccctaaaagcttcgaggccttgccacgaagtatacagaatacataccctccttggcacaagccaggccaccagatcccccgccgaccaccaggagatcatagtcccgctgacctgctgagagaagggatgagaggtgggacggactgtctgtctggttaaacgtggtacaggatcaattttatcaggattggacactccattctgtgatggtcaggggtgacaagacaccacacaacagagcagaaagagtgactcgatacacatagtctgtgcaaatccagagaccaagccatatggtggtgaggttggccgtgggcgtgtgtgatcatctttgcaaatcacacgcacaccataccaaccactctgaactcaaacctcacccagtgttctcagccagacacagaactaagatattttcttttttattctatttatttttgagacaggatctcactctgtcacccagaagattgtagtccactgccctgcttgggggagggatgaaaggtgagaaggaacacggtcagcacagggctgggacatagacccggaagggcccccacgacaggggcacagtggcacaatcacagctcactgcagcctctacctcttgggctcaagtgatcctctagcctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggctaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccgggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatgttcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccccagccagcatgggctggagaaaggctctctactgcacaggggcctcacgtgactgcagggctctggggaggtggggcacctgtagcctgacccccaccttgctgcttccaaagcttccttgcccagggctgggccttgtggggcaccccccacaccgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcggagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacgtgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacggggcctcaccggggacctgcccacagccacatgaccacttactttcaagggttccttctcagaggcctctcctgcagagctggcgccccgtggcctccgctccctccggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggagacgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccttcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggaacaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaactgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagcccaataggcactgccctgtccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctcggcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcacttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccaggggtacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatggggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtctgcaggccatggtcaatgatgaccatcttcaggggctcataggatgacaggttccacagggtgcctgtggggtgcgattggccaatctgtgctgaccatatgcaccgcctgcctacctccccaggtggccacgctcaggacctgtcccactctcctcatgtcccagctcatgcagaacagtaggaagtaacaaaagccgtgagtggttccgggggacacccagtactggtttccagctaggaaggagccccaaaggggaggaggtgcagaggagggtgtggcagtgctgtcccgtcccacccattccctgccatgtggcaggtggcactaacactcctgaggccacagggcctcacagagacacggtgaccctacctgtccctcagctctcacaaggcacaagccccaccactgcacggttggggtgggaaccaaggaggtgggtcccaggagagtttctgtgggggcaggaggtgtgaaggcaggaggtgaggggacatgcccgaggggcgcagcgtcagcctccctgctatggtagagactggggaacctgtcacagtgtctgggcctgatgcctggctcctggggcaagcgtctcagcagctgcactcctgcctaccgggtgctttcccaggcggtcgcaggccgagtggcctcgttcctcccgggttgagcctcacactcttctcttcccaggggatgtgagcatggccaggtcccactcaccagtgacaagctcacggacctcgttgtcccgggcagccctcagcaggcgcaccagggcaggcacaccaccgcagtcccggatggcggccttgttgtcagtgtcgcggccataggagaggttgcgcagtgccccacaggcccggcgccgcacctcagcccgcgggtggtccagcagtgccacaagcagcggcagcccccgcaactgccgtacacgccgcttgacaccctcgttctcaaagcacagatgctgcaggtaggcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacagcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccgaactcctaccaccccagggtccacctttcttctgtccctgacgagagccaaggccaattcaaactaacatgcatgactaactcaactgcgccacttgacaagtggggcactctgtagttggggggtggagggcagacttcccagaggaggtagccacaggggacggggtgcagctcacctggtatgaaggccccgcccacactcaggcctcctccttgtggccgtgccatagtcaggctccagctcagggccaccctcgtcatcagcggccaggctgcgcgtgtcatcctccaagccatacggctctgcctggaagcgctcgggcagggagcggccacctggtggcccaggctcaggacccaccgggaaggcttcccggtggccaggcagtgtgaagcagccatcaccagggcctgggccaagggggccagcacgtgggggccgcatgcccagccctcgggacaggctgccatagctggggctgtcccggggctcggggccttcgggaaagccacccccactgctgaggtaggctcgagagagtgtggccactgggccaccaccacgcagcaggaaatgccggtccagggcaccatctgcaaaagggcctagtggggggccgccatccagcagggggagtccatctgggcccacgggcacctggcgtactgtccgagtggtcaccgtcttgacagtcttggtgacctggtggatggataggcaggtaggtggggtagcacgagaggcctagaaactgctttgctggggtctggctggccttaatttcccactcgagcaatgagaggccccacgtggcaagcttccatgtccactctgcaggtgggacagctgcagcagcctggccctgctcacccacccactgcctgggcctggccataccttggtctcggtgcgccgggttgtgccatcttcggatgtgacaatagacacatgggaagtgggtgtgccggggtcctcctccaccgtcacggtctcctccagcacatcaggtgcctccggcatcgtggccagtgaggcctggctgcctgggctctgctcctggggcaaggagggacattggtgggcaggcctgctgctcagtcacccctggagtgcaggtctccacacacagcagctctgcctcagctcatgctggccagcacaccagggtgccttcctcctggtcctgaacccacccaccccaaggcctgtttcggcccaagctgacaaggacagcaataagttcttgccctctgaacatcgaggtgctaaccctgccccggcaccccatcctggggggaccctggggctggacccccatctcaggtctcctcaggctgagttggcagataaggacatagaccctggggggtgaagtcttcagggccctccccaagctgcatggcctggctgccacaggctcctccaggccccaggaggtgccagtgagacctgcagcatgccttcctgatgtcaaccaccacccctagctgggacatcatggtgtcctggggcctcctccctcacctgccccagacaccttgagtatagaagccttgtgggggctgtttcagcactgcctactgactcctgtggccacactaaggttcccgccaccaacgccagccagacgccctcaagggacagaaatacgcagttcccagaacaccccatgcacctgcagcaccagtatgtccttattccttccagcccagacattcttgagtgttgtgtaggcacaggtttgccctacctcgggccagtggctggcgcccccagtgactgagactctgggcatcatatcagagaccagacacagtagatttgagcctatgggtgcccttgccaccattctgcatggggtgacgacactggaattctaggcaagacaactctggactgagacttttctatccacatgcctactgactggacttgccagtggggaaactgaggctcaaagaggataggctggcccacatcagagccaggcccaacccctgccgcgctgagtggcttgaggacctaagactcacagcctgccccgggcctctgactgcacaggtgcctggccccagggccacatggcaccaacatccggggatcggcatctagccaggatgggcaggagctgaaacccaagccctggtgggtgggtcaggcggagcacattcccaggcagccagggcagggtcagcaggaggacaggtcctgctttgtggcccaggcccctggtccctgcacaatgggtcccttgcctgggccccctggggcctgcacagacactaagctctgccaggctccagaggcagactctgcccattcttgggcctgggaggtgagccaggttagatgctcagcgctgccctcaggacctgcctgccaaggctcgtgggctgggaagcctccccaggtcagggtcctatcctgggggaatacttgacccccaaatgcatgcagtgcaggtgtccaggaaggggcctgcaccaacatgttaggacaggtgtatccctcaggctgacagaggaaagaagtggccacagaaggcacctccccctctcccacaggcagggtcttggaggatgacagataactttatagatggggaaactgaggcctggcagggggaagaggatttacctagaacttcacagtccaagtgggatttcaagcacccccagagaaggcaatctggcaaggaaggctttgggcctcatctcgccctcagtcttgagatgtaggtggaatgcctgctgtggacctggctaggaaaaggggacctgttccctgggaaaaagaaatagactgaggcctagagtggggacaactggcacgctgccaggcagggcaggctgggctcttctccaaaggcactggggagctgggactgctctgaagcaggagaaggcttgtgtggcccatcactgctggggctgggctgccccatctgtatctggcaaatgtgtgtcaggccctgagctctctctgctgggccctgggcggggctcatctgagttcaagcaggggcccaggcactgaggggctgcagttctggcgacagagtgaggagggtataaagcaagactgaggaaacgttacccaggactctgccagtgggatgtagcccctcatatatgtatatatttacatctattaaaaactcagagaaaaaccccctcttccctagctaggcagtgggggtaagcgggagaggaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccggcccctgctacacatgcccaggcacacacacatgcatatacatgacccctcagacagggacacatgcatgtacatacacgtgtgcaagtacccagcccggcacaggccgagcacatcaacccgtgtgctctaacagcaccccaagggcacggcgcccactgttcccagaggcacactcgtgagcacacatcctcccgtcctccaccgtgtatcggagacccttatccatgcagggcctcacagagtctcaacacacagggacaggggccaccaactctgccaatcatctgcccagcatccactctgggagtctcagagctggctggcagatggagaaactgaggtgtagagtagtgagaggcccatagccagctggtggctcagctctctgcaacatctttagggtggggctgtggaatggtgggctgactctcaacaggagttggctgcagtccctggatccctgtctggccccagtgtccatgtctgacgtgcacctgcccaggctggcccactctcagggaccctggccctgcagccccacacagcctctgcctcagacccaactctgggctgctcccctctgtaccctagacatgggctctaccctgaacaccccacctccagcccaatcccacatgctgcatcctgtcagtcgtctctcatcaccccctccccagctggggccccatccttgctcctcttgcaccccgcccggcctcccagcactcatccctcccttggctcttcaatctctggtgcaccaggtctggggcccccaggactggcccagaaacaggctgctgcccaggcctggggtttcccatgagctcccttgggcttgtgggaggggccagagtgaccagggaggtagaccacctacccctgctcacaagagggtcccgggaacacagggctgagcccagcataggggctctgggccccatcacgcaccttcggctcagcttcttcacaaggaggtgagaaggacagagggggctggggtcgtgggacgtgctgggtagcatcagtctcacttttgtggcaaaatgcaaggaacacagggagcagaaaagcaagattggaccaacacacagagggatgctggggcacaggtggctgggccctggtcccatattacttatctacccaaaccaccggacttcacagatgcaccacggtctgtgtcctgaagaacagactgcaggggcaggcccctcccctgtccaaggcctggctagcacacacagagaatgagttaaggtgagattgcacacctggatcccacacctgcaggccaggctcccagagggcaggaggtggctgctgtccgatggatgaatgaatgaatcttctccatccccattatggccctcccaggtagagtccaggacaagccaggctggcatctctcaccaggcagcaagcccttggccaccacaaaatgccctttcccttggtgccacagcctctgaccagtctccaagacctggagcttacttctccacacagcagtgcacctgccagggcgtggccccaggcagagatgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtaggacaggcaggggcctagttgcccaggtagcaggtgtgtgggagacctgcctcccaccacagagggtcttggctggtctctcctctgctcagtttccctgcctgttactgaacccagcactgctctgagcagaggacaaactgcctatgcctccccccacctcaatgctgagagggggaggatcccgttttccttagagatctcctccagcatccattagtgggcagggcctgtctctatccctcccatcacgtgcgcctcggaggcagagaagacttccattaaagctccggaagctcctttgcaggtcccgggagtcagagccggcgtagggggtgtggaggggagaggaggaaccctctcagggagcagaaggcctacccgggcttccctcttcagacttcagcctccttcctgcacagacagaagccgctcaggaaggccctggctctccacccgtgtccccaggcacctgtcctgggcgctggccaagaagcgtccatccggtccgggccggtgccaagaggagggtcaaactgccaggggtcccgacccccccaggccccgcggatgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtgagatctctccagtctcccagatcccccctcaccctcctgcccagccgccactctgaatgggcctgcgaagaactgtccccacagagttcgatggggacctggaaaagggccctgcaggggacccccactttgtatcttgggttctccccatcgaggcacagaagccccgaatgcacccccactgctcccccaggccagcctcaatgtgggccacaccctagggaatctagttctgctgcagtgaaaaatgggaggggaagggccaggctggagccaccttcttatgtcaaaccccacaaaggccaagccaatggctccagcatcacgaacagggaaacaggttctgagattaaatgagctgagaccaacccagggagactcagtgggtctggcaagagaaagggctcgggcccaggcctcccactggcttctccgcagacccctcagaaaacagcctccgcagggaccactccctgctgccctgagcgccatatacagaggccactcggctagcatgctcaagattctaggtacccaccatgtgcccctctgagcctcagttcccccacctgcagaggggtgagctaccctaccactggctggacccctgtatcttgcatctagggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaaggcaagttccctgatggcacccctccccactgggtgggcgtcagccctgtttcagctggctgtctagaggaggggccccttcctgctggaagatgaagggcaggtagccaggaccctggagcagcccagtgagtgcagcagcactccccctagcctggttccccagcctcagcccccagctacctgccttgccattgccctggcttcccaaagcccgggctctgaccctgtggctcagcaggtagatcgctaggcacttcctactgaaaccaatctgggaaacctggccagcccaaggaggccctgcctcccctagtatcctcatcagcccagccagttgagctgcagccctggcaacacatgctctcttcaatcccagcctgagaaaatcaagggtagggggtcggggggagagttcaggggcaggggtggtaggtggaggggcagtagcctgaggtcttgaagtcttttgcctgaggaggtcagggtagctccaggctgtgggaacatcttcccaccagggcatcaaccctccggggtgccttgggtcctcccacactgcctgtccgaggacagttccggtctgggagggttggactgagcacactggcgcctgagaggcggcctcggggtcactggcttccactgtccctatatggcccagctgggcccagcgttctgcttccccgcctcaagtttgagggtagaggcctcacattttggagtatctcaagtctgagggctgtgagagtggccccagcaccgagacccaccagaggcctctgagcaccaggggccatgaaaaagggccccctagtgagtctcggaccctctggggacattaatttgactctcaccatgcactggtgctgggctgggccttctatgtgggtctcatgagcagacgtaggaagcatgacgcctgctggccgacaccaagtctggacaccaagactcaaggagtagtcaccaaccccaggtccctcggcctgacacaggctgctggttctgagccccacatgccccagccaggtgaggagagcccatggggctgcctcaacagagaccagcgtttgctccctttctctctagatgagaagggccaggctgccccaagctcctggcatgtgtgtgccaggcgcaggtccccagagtcagggcccagcaggaccaaagaagggcgggtggaggtgcaggtgctgggagtatgctggggggaggtctggctgctgggtttagcggggcagggagctgagccagggagacaggactctgcagggagagccctctagggtcactctgtgaagaacccagaggccgcagcaggaggcaacccccccagcctctaagctgggtggtgaggagagcccccttccccgtggctgctgggacagctccaccctgactccccactgtgctagccctcagtcagtaacaggaaccatgataatcacaccacatcccaagtctccctgcatgtacttgttccggcctcctaaccccaagccaggggctcttgctgtttcatctacaggttagagcactggggtgctgggaatggggtgtcccagtggtctaactgctcactgcataccccaactttagagttcttagggcctggccatggaacacagaaggctctatacctcctgaggctgagtaggggccggagcccagtctgaggataatggccagcagagaaaatgaggctcccaggtcagcctctaagctgcaggcagagctctgggcctcctcctggggctgacccaccagtgcatgcaatgaacactgtggcagggttaggcatggtgcaggcaaacccctaaagtgtctctaggcagaccaaagagctgcccagaacagaccccatccagctgcctgggccctgagggctcagtggagggtgctgttctgagtgttgggctgtgtcctgcccactcttcacatggtgcctagtacacccaagtgggacttccagcccaacctgggatcccattttcctttcctccccaggagccccagcaaatcttgcaataagcgagcgcatgctggcttgtggtccaccaggacccactgattgttttcccacttggcaattttcacccttcccaagtcactaggctgttacctggaggaccagctgttgccaggccattggcaggggctgcccactgcccatgccaccactgaccatgccaggctgctgggcacgctccagctgtagggcaacatggcgccgctcctgctccagtgcccgtgtcagcctctcgaagcgggcctcctgctccttcaccgaggccaggatgctggcggccgagtgcacattgcagtcctccatgaccagagcgcccgccagctgcaggcaaagcagagtaagctcagtggggtggggcacagcctggcaaggccatcatgggcccctgcccgccccactcacagaccatacaactcactcccagaccagagcatccagccctctagagggaagcacactgattaaattctaaattaaaagccattaatccgaggctggccggaagcagccggctcactccccatgggttttgggactctaacctggctcctctgcttcctgctagacctagcagaaacatgggccgtgggcggcttggagcccgctgggaagggcaggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcccagcttgccccctggctgcccagaatgtttgtttttcatgggtaaaaagaagcaggacaagtatgcggagctccaatccaggctcaccacagtgggcagggcatagccacgaggccacactgcccggagcacagtgagcatggccgggtgcccagggctgctcaggcatcctcctgcccagtcccgccagcccactgaggccaactccgctggatcccttgcccttgcaccaatatagggccctccacggggaggacacgcactgcgggtgacatccccagagcgtcagcactgctgctcactggtctggatggagccagctgcaaggacagagagcccccaagaggaaaagcagcgctgggctcagctgcgccagcaacacggtgcggggacatgggtgcacctcataggtgaagagacactgtggagcccagccccaccgacagctgggaaaacaggcccagcaagagcgagagaccagtgcaggcccccaaagctgctctccatttccccagcacctgtcccacaaatgaaactgtcaacacaacctttcggggaagccagcatgagtggaggagctgttttaagccagccacagaatggaagaatgcagggagagctgggggccgccgcccgagactgaggtgcagactgggcgctccagcaaagggataaacagcactgcactccccaagcatggtcacacagctcttctctacacacctgatgctgtctacccacaggccccagacccaacacaggggagccttgtgcactaatggactgaacctagtgctaggcccgaggtgggaatggtagggtattccccctgggacggccagggcggatggcagggcccatatcactccagccctcagcccagtcctggctgcagcaccagcccatctcagccgaacctcagaagcaagggacagaaggaaatgggacgctgccttggatggcaacaatcaggaccacaggatagccactggcctcatggacctggggtggcttacttccctccctgtgcagagacatggaccctcgtctacaccacacaccccatcccccatctagcaggaccaggcttgggctgcagaccctgcggacagcttccctgacctaagcccctccagcacaccctggctctggggactaaagatgcccaccctaaagggggcccactggctctggctgagggctcagtactccaaggccacagtgggaaggtgaccaaaccccacgatgaccttctcattgccgaacttggcttgattggtgcaaaacaatcatgtatctccctggaaacatccagaaacactggccagtgttgtggggagagtctggcagccatgctcaggagagcagagaccttggtgctgggcctgtgccatctgccccagccgcagggtgcaccctgcatttgccctggggggaagtgccctaggcccgcaggtcatggcctcggcatctcaggtgtctcaagagcaacccgggatatgctccaggcagagcacagaaggcccaggcccactcccctgacatggtggactctggcctatgacaggagccagtctggatacaagggatcctggcccagaaccaaagagggctgcttttcagatggtaactcaaaatgctgtttttatattcaagtaataaatatatgatgtcaaggaaagcaaaatgtgcatggattcttaagatcgatggggcctgagtggatgctgggcagagtgggcaccggatttgcttttgctagagcccaggagggccctgggggaaggctaggaagggggacactgcagggaccttggctgtccagccaatgccaccttggcctcccctaacctggtaagggcccagcattgccttgtcgggtggacccctcatgaccccccacccaaaacacagcaaccagcttcatgcccaactctgaggaggccacttcttgccaaacatgctggccccagaagtttacttagccgcaaggcaggaatgacattgcacagcccacgagtgaccagacttcaggaccatgtggacaacaccatgttccaaccagaaaacatcaggaactgaaggggggctggaaaggtcggggctaaactgaaactctgaaaaataaactgcaaaacaaaagtgacgacccagcccccacccagccccagccacaatggacattggccacgtacccaagggaatccaggaccaggacgtgagcctccaggtgctctcacaggacaaactgctgggcaagcaggtggcccgaggagagaagcatggcaggagaagagggtggccccaggcacacagcccatggaagactagagggagggcaagcaaaggagagacagcgaaggatggacagacagatggatacaggggtggatgggggatggatgaatgaatggagggtggctggggcagtggtggaggatggacagagggacggacagattgatggacaggtcggaggatcgtgggagatggacagagatgaatggatggatgggggatggtggggaatggacagatggatgaatgaatgggtcggggggatgctgaaggatgaacttatagatgaatgaatggatgggtgggtggagggatggtgggagatagacatacagatgaatggatggatgggtgggtggggggatggtggaggatgaacaaataaatgaatggatggatgggtgggtcgggggatagtggaggaagaacatatagatgaatggatggatgggtgggtggggggatggtggaggatgaacatatagatgaatggatggatgggtgggtggggggatggtggaggatgaacaaacagatgaatggatggatgggtgggtggggggatggtggaggatgaacatatggatgaatggatggatgggtgggtggggggatggtggaggatgaacatatggatgaatggatggatgggtgggtgggggatggtggaggatgaacatatggatgaatggatggatgggtgggtaggtgggggggaatgatgggagatggacatatagatgaatggatggatgggtgggtcgggggatggtgggagatgaagatatagatgaatggatggatgggtgggtaggaggatggtaggcgatggacagagagaaaaacagacgcatagatgggatggtgggggatggatggatgaacgtatggatggatggggggggatggtggaggatggacagacggatggacagattggggaatgaggggtatggacagacagacgggtgaatggatagggaggtggatgaagtcatagaagggtagacagctagatggatgattggatgggtttacagatgaatggatggatgagtaatagatttgtgggtgggtggctggagggatgggagaagaggaggccagatagaagggggtgtaactgagtgagtgaacaagtgtgtggacaggagactaataggtggttatataagaaaatgaggggagatgagaggatgggtgaatggtggctagttggatgggaaggtggctggatggatacgggtggtggtagagggataaaatgatgatggaagaatgtgtaggagggtgggcagatgggatgctgaaggctgggtggatggaggagtggatgaaggagaaaacagagtgcgatgcatgaatggaagggggggtgggctgtgtaagggccggtgggcaggaaggaaatgctggaacctcactaagtggggaaagccccggcccgcaaaccctctggggcaaaccatggtcagcacacactgtcaggaacacgaaggcatggtgaggaacctgagggtagaagctaaatcctttccctgaaaccaaagctgacatttgacgacatcttgccaacccagacattcctcctcgggagtgcggccagagccttgtccggaaaatgaaattatggggcccgagtccagtgtgggttgaggaattagaggaatttccgaagggtcaggccagtgaagggtggcaggcggggcctggctcccatcctgaccccttgccagctgtctaccagaacacagccagggctgcgctggcccccccctcgaggggagagacgggacggatgaccatcgagcctcctcccataccccctttcccctccacccttccctacaaggaggaaatgatgccagaagtgccctggcaggagttggacccaggcccagcacccaccttctgcctgggaggacatcctgggagctgccagcacagagacttcctcgtccccctagctggccaggccttgtgggggccccatgtttaccctgttgcccctactgtggtcagatggtgcccaaagccttgtgggtagcttctggccaagcccactggccgggcactgtactcaagctgggacagggccagagccgggggcctggggttcacagggcggagtccacatccatctgtgccaaggccaggaccacagtcccttgcagactgtgttggatccggggtgcctgggctggggatgactgttctcagcctccaagcagcagaaagaacccccgaggaaagacgcacaagcgtgactttgtgagaatgaaactttctgtatatccaaaaaaaaaaaaaagggccacacagtgtggtcatgttttttaaagaactgacaccatttagagcaacacatgcagtgagcgttttgatgaaatgacgggtgctggcgttactcgcagaccatgactccagcatggtgaggctggtgtggggtgtgcaggacccatcacactaggctctccacttctgtgcttttgtaattttccataatggaagaagcagccacaaagaaaatgaaaagacaatcgacatgttgggatcaagtatttgtaacatacaacaacaaagtggcatcctcagcccattaggtgctctcataggctgctccagagccccacagtcctgcccctgccagtctaccactcctcgaagcacgcgccgctggcataatcagaacctcagtaggaaatagacaaaccagataccctccccaccaggcaggcgagtgaaagcagaggccagggaccaatctccccaggggccagggcggtgcccactgtcagagagccataatcagattcagcctggaaatttgatttccccagcagaggcaatgagccaggctggatgagacgccatcgggggttgggtagagggacagagatagctccccaggctgtccacatgctcactcagtggcacccgctgatcatgtgagggaccactcccatgtccagggagaatactcagaaagggcctcttcccacgctgctcctgccctgcactaatgcagtgcccaaggccaaaggtggccaagaccaaagctacactggccagccccagggggcatgctggatgggaggtccagggggactaggggctgtgtggggctgatacggaagctggggtccggtcaaggcagggtcactgctgggggccagggagctgggaagcctaaggttagggcaagggctggctctagtggccgaacgagcccagtgactgcaggcaggacgtgacaggtgagcaggcagggcaggcgagtgtcccagcaactgtccctcctctgtgggaggcatgagccacagggagccactgctggaggtccctaaagggtctgggcttaagattctcaatccagcaggtcacagacacctgctccctgtgccaacagcagcatcctttaagtctccttggtctcctgagacctgcctctccatgaggagacatgagatggggtggaaaggagtcctccaggtcccgattcaaaacagcccccaatgcccttcctgtgcctgacccagactctagctacagctgcagcagtgggtggtcctgcagactccaagccgtggagtagtggcagtgaggggccacattctctgggctccctgctgcatcctgcccagggcaccaccaagggctcaaaggctggggagctccagggagagggctgcagaggctgccagtgcagtgtcttctcccctgcacactcagcccacccactccgcccccaatgatgagcatgaagtttgtaggagtgtggagaggtgtagtgccctactaagtgggccggacattggtggcggtggctggcccattgcctccacggcttaccgggacgggcacccaccccgcaaggtgccgtgtggcccatgccctgccttagggagggcaggcgcagtggaggcggaggcggggtgtaaaaggcccagacatggagctgagccccgtcctctgtactctggggtgggcacagggaccaaagcatccctgaggagcgaactgacagggttcacagctaggctgggatcagaggcagacagccacagggcctgggagccctgccctaccatgccctacggccccactgaggcactgtaggagacagctgtccaccaggctgaggggcctcagcgggcaggtgcagcagtcaccacgctggccaccagcctgagtgcacagggccgtccgcctgcaacgccctttcccccctcattggaagacggggttagaccccttcttcccagcccctctatcaccatggaaacacccaggcttctcctgagggacagagcctctttgtggtgacacaaagcccctttgaggggaggtggggtgcagcccctgggagcctgtggccaaagggcccctggggggtaaagcagggcccgccggcccagcccccctcccaggtttcggagccaaggaagctgaggtaggagagccttcaggttaggccagcccgccccagctgcccacccagaagggtctccggatggatgagccggacagcccaggaggccaggctgaggctgggcagagacagcaccgagaagcctctctgcaggagctggggggttcctgctttcccctctgttgttttgacaaagaacacactctgcttagataagtggaaaacagcactggcaggggagctcccgccagtcaggaaatgcccaggatggctgcaggaacagtgcctggtgggagatggggacaggaagtcctccgtgggagggcaggcaggggccgtgagacggcaggtcagacagtgggaggtctggcaccaggtgtgccgagaggactggccctggcatctgggccccactcagtttactgtcctctcacttctcaagcctcagcctccgtcttcacctatccgcccagggggaaatgtcactggccttgctgcagccacaactctgggacaggccagagttggataaaacggaacctcaccatggcttggcttattccagggctggggaaatggaaccctgaggatgatgtgggtccctggcacagtgacagcatggctgtcccatccatgctacagccccacagccagggaggcagaggaggccaggccacatttccccagactcccagccctggagcccctcctgtactggcctgagagtccctgcccccacccactgactgctgctgaccaggcacctggcagctccctgcatgtgggcgccctgcctagaggccctcccgagttgacctcactctgacccacagcagctttgctaactaagcccctggggtggggttggggtggggatcactggccccctgcggcagcacgaggaggcactggcccagggagagatccatccttttgtaggcaaatctacctgactactagggagtggggccaagggctgcccccacagggcagtgcctgggtcagcaagcacttgctgcacccccaatggaggccctcaccacacccctcccaacctgccttccccactggcaccccactctctgctgacacctgcaggcacaggggtgggggttgggaccctccagctgccgtggcagggagtggccatagggtggttgctgtggtggacgtaggccatatggttcagaatggatcagaggatggtgtgggtgggagaattaagtctgggctgaccgcaagggatcaggcctgggtggctggagggaggggccgggaccctgagtgggagggtgcaaagggagtctctgaggctggagaggctgagggaccactagatgcatgaagttctggaagaaaggggttcaggctggagacagaaccaccggcaccttcagcctgtgaagccgagagataagacaggtgcaagccccactgcctcctccaaaggaccctcccctgaccttctagaacaaggggacaaagtcactttcccagccatcatcttccctgcactggaaggggcagaacgaggacccagcactgagaggtgagcctcaggaaggaggcagtgctgccagcccttggggacaacagcctgtcccctgaaagtcccaaaacccttgggaaaggtgctcctcactgtacccttctcccacccagcacatcagaggagccagtggtgtgagatcttgacccagcatgaagtagagcccaccctgtcatatgcagggaggttccatgtcccctttggtctgcccttgccccagggtcctgtgtggcctctggccagagctggctgctcccagggtgcctggggcaccgctcatcccttccagagcctgagctggatgctggccttgccgctcccaaccccctcctctgctgggagccagctccactccggagtgcccatggcaacaggcctagacaccaacctccagcaagtgcacaaagtcctgcctttcatatgcaagcaacacagagggccaggcagggggctgcaccaccccatccagggcagattccaggccctgcagcctcccatctggctcccaccgccacataccaggagagcctcgggacttgactgtgtgtccagtccccactacaaagaggtgggagaagtgctgacagtttggggccctcctcaaaggcacctactggcacatgtgtgcagccacccacactgctacggtgtgaatgctagtgttccccaaattcacattaaaacctaatctccaatgtgacagtattaagaggtagggcctttaggaggtgattagtgcccttatatgatcagtgtccttatcaaagcggctcttgagggctggtttaccccttccaccatgagaggacacacagcgccatctatcaatagccctcaccagacacggaatctgctggcgcctcgatcttggacttcccagcctccagcactgtgaacagtatgtttctgttgtttataaaggactccatctaaggtatttggtggcagagcgtgaatgaactaagacacacacagacacacacacaagcacacccaggcacagggacccacagctgccccacaggcacacgcaccagcaggcacactcgtccacacccatatggctgctgcttatcccacctagaagtcccgacaggccctttggggggtgggggacatcttggctcctggtgaagatcagcatgctaggcagactccattcctgtcttggacaccgggcaaggcagaccccctctgagacccctgaggccgggtcaagcctgcccctgacaccaagatctgcaggaccccctgcctctgatcccacatgaggttcctctgagacaggtgggagtggctgggcctgcagaccccgagcttgcacagacccacctgcagggacaagcacaacttacagcagcctagtgcccagggaagacccttccaccatgggaggactcaggaagccgcttcccgctgagtcacatttagcgcatttcttaggaaacagctggtatgtgccctagaaggttaaagacggtgttcaactccgctggccacagaccacaatgaaaaggagctgctggctgggcacgatggctcatacctataatcccagcactttggaaggccaaggtgggaggatcacctgaggttgggagttcgagacctgcctgaccaacatggagaaaccccatctctactaaagatacaaacaaaattagctgggtgtggtggtgcatgcctgtaatcccagctactcaggactgaggctgaggcaggaggcagaggttgtggtgagccaggatcacctcactgtactccagcctgggcaacaaaagcaaaacttcatctcaaaaaaagaaaagaaagaaagaaaaggagccgctataaataatgaggatcccatggagatttaaaggaaatcccagcagaggcagtaaacagcagactgtagaaaacacgcagtgtgaggctggagaaagtacactaagacggtcctcccaaccccaacagcaaacaggagagatgacaagaggatggtaggagccacagaagacagagcccagggccaaacttccacatgataggagtttccagagcgagaacgacagacagtgctcttccaaccacagaaaaacggccagaaaccacctcaacaggagtacgtccaacggggctatcagcgtcagggctggaatctgagttagggtgtgagccttctgtccagaaaagaagcccaggaagtcacggatgtgtctacctctggcttttacaattcagtctcatttcctctggctcctaaatgcgctgtgtccacttcgaggtgtagggaggagggtgcccagctctgacctgcgggctgtgctgaagcctgggcctctctctataccaggccgtctgcaggcctgcaggggctgcatactgtccctctgtaaatgtcagcctcaacacgctgctgcctgctgcctggctcccgtctctcacagctcagaagctgttttatgataaaaaagagctgacagctttgttaaaacaaacaaacgcctctcctctctacttgagatcttttacaaagttaacatcgctctgaaaccccataaggaaaaattatggtgaggtttctggattttcagaggcagcaaactcatcttacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaatttgttttccttttctttgtataacattaaaataaaaagatggtaacagactaccataaagaattatacaccaacaaattagataacccagatgaaatggaaaaatttcctagaaacacacaacctaccaagactgaatcatgaagaaatagaaaacattgattagatttacaactagcaacaaaactgaatcagtaatcaaaaacctccagcaaagatggtttcactggtgtattctaccaaacattcaagtaattttaacaccaatcgtcctcaaacttttcccaaaaataaagaggaaggaacacttcctaattcattttatgaggtcagccttaccctaataccaaagccaggaaaagacactacaagaaaagaaaaccacaggccaataacccttatgaatactgaaacaaaaattctcaaaacaaacaaacaaacaaaaaaacactagcaaaccaaattcagctgcattttacaagaattataaacctaaccaagtgggattttactcctggaatgcaaggatggttccatgtacaaaaatcaatcaatgtaatacgccacagtaatagaataaaggacaaaaatcacaatcatgtcaaatgatgcaggaaaaacatttaacaaaattcaatagtctgtcatgataaaaacactcaaactaggaaaagaaggaaactttctcaacatgatgaaagctatatgtgaaaagcccataacatcatactcaatggtgaaagactgaaagcttttctcctaagatcataaacaagacaaagatggctgttttgaccacttccattcaacatagtactagaagttttagacagagtaattaggcaagaaaaagaaataaaagacatccaaattagaaagaaagaaaaaccatctctgttcatagacgacataaccttatataaaaccgtaaagattctacatgcattttttaaaaactctattagatgtaaaaaatgaaatcagcaaaggtgcaggataaaaaatgaatacccagaaatcagttgcatttctatatatgaacaatgaacaacctgaaagggaaatttaaaaaaactattccatttacaataccattaaaaagaatagaatacataatactaaacttaagaaacttaagatctgtacactgaaaactataaaacattaccaagaaaaatttaaaaagacctaaatcagtggaaagatatcccatgttcatggctgggaagatttaccactgtcacaatgacgatactactgaaagggatctacagattcagtgcaattcctattaaaatcccaatgacagccaggcatagtagcatgtatctgtaatcctagctagtcagaggctgaggctaaagaactgcttgaacccaggggttcaaggccgcagtaagctaggatcacaccattgcattccagcctagatgacagaacaagacctgtcaaaaaaaaaaaagaaaagaaaaaaaaaatcccaatgacattgtttgcagaaacagagaaatctatcataagatttatatcgatctttaaggagcccaaagagccaaaacaatctggaaaaagaacaacatttaaggactcacacttcctgatttcaaaacttactacaaagctacagtaatcaaaacagtgtggtattagcataaggacagacacaaagaccaatggaatagaatacagagcccagaaacaaaccctcatgaatacggtcaaatgaccttcaataaaggtgccaagaccattcattagggaaatgatggtattttcaacaaatgatggaactggatacacacacgtaaatgaatgaactcacacccttaccttattacatacacaaaaattaactcaaaatagatgaaagatctaaacataagacctcaaactataaaactcttagaagaaaatataggggaaagtcttcatgacactggatttggcaatgatatcttagataagataccaaaaacacaggcaacagaaggaaaaataaattgtactacatccaaatttaaaatgtatgttcatcaaaggacacaatcaatatagtgaaaaagcaaccaacagaatgggagaaaagatttgtaaatcatatatctgaaaaggaattcatatccagaatatgtaaagaactcccaaaacttaacaacagcaaaaaaacacaaataacccaatttaaaaatgagtggagttgaactgacatttctccaaagaagatatataaacggccaacaagcacgttaaaaaatttgctcaacatttctatcattagggaagagcaaatcaaggctgcaatgaaatatcaccttacacctattaggatggctagtctaaaaaaaaaaaaaaagttttggcagagatacagacaaattaagacccttgtgcactgctggtgggaatgtaagatcagtatggcaattcctcaaaaaattaaaaatagaattaccatatggtccagcaatcagaaaattctgcattatgtatctaaaagaattgaggccaggcgtggtggctcacgcctgtaatcccaacactttgggaggccgaggcgggtggatcacaaggtcaggagatcgagaccatcctggctagcacggtgaaaccccgtctctactaaaaacacaaaaaaattagccgggcgtggtgacaggcgcctgtagtcccagctacttgtgaacttgggaggcggagcttgcagtgagccaagatcgtgccactgcactccagcctgggcggcagagcgagactccgtctaaaaaaaaaaaaaaaaagaattgaaagcagagtctccaagagatatgtgcacaatcatattcacagcagcattattcacaatagccaaaaaggggaagcaacccaagtgtccaccagtggaaaaatggataaacaaaatgtggtatagatatacaatggaatatcaggcatcaaattctgacatatgatattctcatgatactaagtgaaataagccagtcacaaaaagacagatactgtgagattctatttatgtaaggcatctaaagtagtcaaacaataggaaaagtagaagcacttcaagaaaggggcaaacggggagttttctaatgggtacagagtttctattttgcaagaataaaaaaaagttctgaaattggttgcacagcaatgtgaacaaacaacactactgaattgtacacttgaaaatggttaagatagtaaattttgttatgtgtattctaccataattaaaaattaaaattaaaaaagaggctccctggccaggcgtggtggctcacgcctgtaatctcagcactttgggaggccaaggcgggcggatcacgaggtcaggagatcgagaccatcctggctaacatggtgaaaccccgtctctactaaaagtacaaaaaaaattagccgggtgtggcggtgagcgcctgtagttccagctacttgggaggctgaggcaggagaatggtgtgaacccaggaggcggagcttgcagtgagccgagatcgcgccactgcactccagcctgggcggtagagcgtgactctgtctcaaaaaaaaaaaagaggctccctcacataataagtaagaaattgcataatacccttttatttatttattttttgagacggagtcttgccctgtcgccaggctagagtgcagtggcgcgatctcggctcactgcaacttccgcctcctgggttcaagtgattctcctgcctcagcctcccgagtagctgggactacaggcgcgtgccaccatgcctagctaatttttgtatttttagtagagacggggtttcaccatgttgaccaggatggtcttgatctcttgacctcgtgatctgcctgcctcagcctcccaaagtgctgggattacaagcatgagccaccgcgcctggcctacccttttgaaataaatagtatatcaaaggtaaaaatttaaggctgggtgcagtggctcacacctgtaatcccagcactttgggaggccaaggcaagtggattgctggggcccagaagttcgagaccaacctgggcaacatggcacaaccctgtctgtacaaaaaatacaaaaattagccaggcatggccgggagcggtggctcacacctgtaatcccagcactttgggaggccgaggcgggaggatcacctgaggtcaggagttcgacaccagcctggacatggtgaaatcccatctctattaaaaaaaaaaatttaaaaattagctggtgatggtggcaggcacctgtaatcccagctactcgggaggttgaggcaggagaattgcttgaacgtgggaggtgaaggttgcagtgagccaagaatgcgccactgcaccccagtctgggtgacagagcgagactccgtctcaaaacaaacaaacaaaaaggaaacagttcagatgcagctgtaaaaacaaagttaaatccttgccgtccatttacatcagaataaatactagtttgtgctatgggctgaacgtgtcccccaaagttcacgtgttggaaacttaattcccaacgcaacagtgttgaaggtaggacctctaagaggtgtttaggtcacaagggctctgctacatgaatggattaattccgttacagtgggagtggatttgttatctcgggagcaggttactgataaaaggatgggttccgcctccttcagcgctctctcacgtgtgctcctgcccttctgccacctcctgggggatgtagcgacaaagaaggccctcgccagatgtggcccctcaatcctggacttccccatctccaaaattgttagaaataagtctttgtttttcaggaattagccagtctcaggtattctgatacagcagcccaaaatggactaagacagacagattaaatgctgtgtacaaaactaaagtaaaaataccttctagaagaaaagacaggtgcatctttatctggctgcatgctagggagagttgactacacagagagacggaatatctaaaaatggggaaaaatccaacacacttcaccacaaaatatgaaacatttttgacatcaaaatgatcataaacaaaaactaaaagggtgagaaaaatgtgcagtaggcagaaagaggagtgaagaattaatatctttaatatacaaagactcatacaatggctgagaaacacatcaaaacccaagagaaggcctgtcataggggccaggcggccgcaggagacgaagccgcaaccccctgcaggcacacggcggctgatggaggaggccaggctggtgctggtctctgagaggacaccactgctggccagctatgggaaacggcagggcatctgtgtccccgccagcccttctcactcaggcctggtctcagcacgcaccaccccatcacaccctcccagctccccctcctaagggagccatgctactcatcaccatcttgtaaccccacagttggccactggttcctctgtgtgttgtggatctcctcaaccaggctgggagctcctcaggggcagggctgggcctgatgtgcctgtgatgcccaggacccagcatgaggctgggtgagtgggtgctgagtgtggtgacacatgggtgtttacatcagcccctgtcccagctgagccctgaggctccctccccagctgcctcccgctgtggacaggaccacaccccagggcccagcagagcaggcagccgcaagccagagcccaggttgcccaagccagagcagagatggcacaaatgccatcacccatcgcaccagtgcccagggcagacatgaaaaaccaatcaccacagcagacaggaataagcaatcaccacattccagatgggcaggataggagatggggaaaggcagagaaagaggcacagagagggccacagagaaacatagagaagaccaagaactggaggggggagggaaaagaagggacaagaaaggagcaagcaacaggagggagagtgagcaagtgtgcctgggcagcctcggacctgcccagccaaccaccctcctgcggaccctgttaccagggctgtcgtttggtgtctggctgacctggcctccctgaagtgtggtgacctacgaggagttaagggcagtgggacagcccctcctgccaccctgagatgccctgtcacctgtgccacaagcaagccaagtaccctgcctgagcttctttgtcccaacccagaagaccctgcatggccaaatggcctgagcagtgacattctcggccagacgctggtcctcccacacagccaggcggcagcagacccagctcccactaggctggcccggccggcagctttccatgcccaaggacttgggaacaggcaaggagtcagtcatcctgtccctcccatctgccctagatccctcagcctaggtcactcaggcatccggaggccatggccttctccctaccacttaggcacagcactggctgggccatgcctccacaatgggcactaattgtcactgagaaaccacagggctgtcagccatgcctcccacagagactgctttttggggggacaggcagatggccagggtggggactggaggaacaagaatggccaggagccattctcttaagccatcacccactctgctgaacagcacccatcgtggcaaaactctggcagcgtggatgtgagcagggtatgccttaccatccttcagagggtcctgggggacatggaccactcagcctccaaccctgccatgcttcccaggcgctatgcctcagtcccactggagctagcagccatgataagcagaggaaccccaaacacagataacacctgaggccacgggccagtacacatggcctacggctgtgatcagagtacattcagactattcagttatgggctgtctgcagccattttcatcctacaatggcagagaactgcagctgtgacagagaccataaggcctgcaaaattgaattacttactatcagaccttttcaaacaaagttttgtgtgcctggcctccaggactatcctctgtccctgtggctccagtctctggggggcaagcgaatggcctggcccagcaggctgtgccaatactggatgccactgcggctggcatcctagctcaggcaggtgaagagcagacccagtgaatgtccaaaccaacactgaccagcaacctcgtcagccagccccaaacaggcttgtccctaaagccagacatcaaaccagtggctgctgcccatattcaggccagtaacaaacccaagctggtggcaggaggccctcacatccaccctgtccagcccaggggctgtgcctacccagggtgagaaggaccaggagcacacagtgtccagggccagtccatccctgtcacccccacccgccaggcccaccagaacactctgctgtcctatgtgggagaggatgtccccaagctaaacccaggccactcacctgtcttgagggaagatcagcatgtcccgacacccaccctgcaggctctggctcctgcagggaaaccagagggcatgagtgaggtcaatccagctgggtaggtccctgccggataaaggtacacaagcccagaccgtcctctaagcaggaccttgtcatgcctgatctgaaggtcatcccgtggtgctcctgactcataaccacacactcatgtgtaccttcttgcccccacatgtccaggactgtaggtgacactgggctgccacggttccttgtcagcatgtctaatgctgttgaccatccttcagaaacgtgatccttcagagatgtggactgataatgacgtcttccccatcacacacagcacagcagtattcccaccccagggtagccaggctcagggtcctgttgccccacgcaggtgctcacagccccataagacatctgctccacctccctagagtccgctcccgccttgtgggcgaggccacgtgcctctcctgaggttccctgaggccaacatagatcctgggccctcccaggcaggcagctgcccccaacagtctccagtacagggagggcggggaagcaggcaggttcctggccctggagctgtggccaggtgtgaataaccatttgtctgggatgggggacctggcactcaagcctggggagctgaggcttatgggctggagcaggagacaagggggtgcctgtactcacacagctttcagccttcctcaggggaggaccctgcggcttcctgtctcagctaatggccccggggacacattccctctccttatatctaggcccggggatattgccagagtgttcatgtcataaaaatgaaaaacaggacactgcagacagacagggaagggctgggcctcggatgggaggctgtctctgggggacatcggtaatgagagctctctcccccgcctctacggtgttttctagattgttctgaggccccgcccaatagtcctttgtggtcatggtccattctggtgccccaacggtgtgtttccccgtctcacgacagcctcttcatcatgggaaggggtccaagtgagggtgggcgactggctacgcctcagggtgggatcatggggggtgggatgcagggcctgaggcagggaagaactggggaccaagccaggcacatgtgcatatgcatgtgcgtgcatgtgaatatgagtgtgtgtgtgcacctgagatgggcaggcccggttgggagcccatccaccagcactgcgccccgaggaagaggagatgctgctcctactccaaggtctgaggcttaggaaccagcttttgctctgagtgtgacatttctaggaaacctctggttttagcttaagtgttcacataggttttgtaccacagagaaccatgtgactttttttttttatccctgataagcaccagcctctcccccggagtcaccatgtgccacagaaccgagacacactggctgtgagccgtcatctcactgactctaccaggtgtctcaggttggctatataccccattttacacatggagaaactgggtcccagccagacaagggctgggccaggatttaactcaggtcttcctgcctccaggcctcccaaagtcccccccccccacccagttggggaagtgtgaccaaaggagaacatgggtccttcctcatgggcctcctacctcatggggtccagccaggccaagaacctgcaaccatatggtagagccaatagcagaccctgggaaggggtccaagtgaggcattggagagggcttcccccaggagatgggtgggagcagaggatagcagcaccacaggaggctgagtggtaggagcagccagagctgtgggtatccttcctaagggtgcactaggcacatcagcatcgtacaggcaggggcagagcagagcatctgtggacaacctaagggagctctgggcagtggacggacagagggacgacagacaggacagtgatgtgaaggcagaactagtgataggatcatatgggaaggtggggaggtgctcaccttggggagcccccctgagtgctctgcaagctctggggtcacctgcctggccaaggacccagtaccagccgcctcaaagcgggggaatgaccacgccctttattgggcccttttcccagtgaggatggcctgggcctacccatgccatgggacccccacactgggtctccccaccaaactgtccagacccgatggctggccatggggctctgtcagcccctggctacaccccactgatgccctagtaagccctgtggttctggcacggtatccatggtccaaccagagggctgagaggtctcacactggggcataagcctggcccaggccacacagccagattggcaagctacagtcctttggatagctgacggcacagggcagctcccatgggtacacactgggcccagaactgggatggaggatgcagcctgggctgggtaggcaatgaggggcccaggtgagctcgctctgcactccctgcagtgtggcctcagcaggccaccccctccccaagtctcctcgcttcctgctctatgagcgcgaggtgacactgactgtaggtagctgagaacatgccctggcaacagccaatgcaggcaggtgaatggagtgccccgtggccagtggacagggaaggtccatgctgctcaatgacaatgctgtccactacagcaaaaccgagtgttctcctaggcctgctgccaccctgggcacatagtgagaacacgcccacttctgctgtggacattgaggcacagaccacacctgggaaggcttgggaggcccctgggcacacacttgaaggacactgcacttttggggctacgcaggcacagggctagtccttcactgtccctgctgagcctgtgtgtggtcacccaccagctggccttcaggcttccttctgcctgcaccaagcatgttgggggtaccgaggggccttgcttggctcctttccaactccacgccctcaataggcggcttggaggccgagctccggtcatccaagccaggtgtctggggaagggtcctggtctgccgcaggaagctgggtggagccggtcttgcctgctgtggcggtcccagctgccctctggtggccatgctcagctccccgttgctctgccagaggcggcagcccctcaatcagcaggggcagtgggaagggcctgtgcataactggttatggagtggggggaactctgtggccccaggcacccaccagctctgggtcatcttcccgacctgaaacaggccaagatatgaaggccctgagccaggaaaacctactaagggatccctgatcccaagtcccctcagagtgacccaagacttcatcttgggtttttctgtttgtttttttgtgggtatttttttttctttttttgagacggagtctcaccctgtcacccaggctggagtgcgatggcacaatcttggctcactgcaacctctgcctcccaggttcaggcaaccctcctgcctcagtctccccagcagctgggattacaggcatatgccaccaggtccagctaatttgttttgtatttttagtagaaacagggtttcaccatgttggccaggctggtctcaaactcctgacctcaggtgatctgtctgcctgcctcggcctcccaaagtgctgggattacaggtacgagccaccgtgaccagcccatcctggttgttttgtttgtttttgttttttggagatagagtctcgctctatcacccaggctggagtgcagtggtgtgatcttggctcactgcaaccctcacctccccggttcaagcgattctcctgcctcagcctcttgagtagctgggactacaggcgcatgccaccatgcccgactaatttttgtatttttagtagagacagggtttcaccatgttggccaggctagtgtcaaactcctgacctcaggtgatccacctgccttggcctcccaaagtgttgggattacaggcatgagccactgcgcccggcctcattctggtcttaattgaagctgctgacaaaagaacagacacctccccatgactaagccaccatcagggaagtccccaggacccccaaggcccagctggtgctctgcagtgctgtccctggacccccaccctccattcctggccctgtctacagaatgggccctgactccctatcccagctctaccctgtcactccctctgccagggccaggcggggagcacgacagatgggctggacagagggtggtgcctggcatccgtgtgcagagctccctgctccacccagagaccggggatcctgctgctcctgcaccttctgtccttactcaggacagcctcatgctcccccaggccagactcctggggtgaaggagcacagggaactcaccctgaatccctgtgtagcacaaacagaaggaggggtgctaccctaccctcacagagccacagagatgcagagggccccgggactggggggagactacagggccacctctggagggagtgccagagcaaacatgggagccaagcagcccagatgtggtgggtggggagactcaaatttagcaggattgagggtcagaacttgttctcccaggaggaaccttggtcagaaggtccttgtgtttatgctgaaaagcctgacagggcagctcagccaagagctgggcaggggctggcttggctgtgctcaactaccctctcagctgggacttgagtcccttagcgaatgttctgtgcccagtcctctgctgggcgctggtggaccccagaatgggggtagggtggggacaggggacagctgggagcagacattgcggataggatggggcaagactgggggaaatgccttcccagacacgctgcggctcacactgtcgcctgatctaaggcctggatcacctgcttaggagctgaccggccactggcatggcacaccgggcaagagagcgctgactgcccccctgcattcagcaccatcccagctccaatagagtgagtacaagataggtaacacctgccttgtttggaccagacctctaaacaccgcccagatcccagagtaaaggcagataaggcagtagttaagaagtaggaagaagtaaaggcagctaccccagagaagctaaggtcgggagaggtggaggctcccactgcacccccctggcccataccataggggaggtttcccccacagcagcctgggtactcacctgaggttattagacagcagcattaagagcctactctaaaaaatacccacggggcacctttcttttccttatttctaaatatgcctggatgtagggaaagggagctgaagtcctttagttccattttaagtatgttacattacacatagctaagaaacggtgaaatattgtaagcagccaatatttaattatttaaaaattaaaataggctggagctctcaggccacctgcccagggcgactccccagcaaaccgagcagtctccctcagagtggagatgacatgtctccgcaccggcaccgagggggcgcagggcggcgtggggagggggacccaggccgggggtccgggtggcgcgccctctctcacccccgaggcggcaggagcagcgcggcgcgaggacacctccgggccgtcggtgcccctgagcttcccggcggcgcgctgccccaggaaagttcccggcctgccgcccctcgggctgttggaaagtttcggcggctgcagggccctggcagctaggcgccaagcgtcgcgcggggcgggcacggctgcggggtcgggccgcgctcggctggagtgctcagtgcaagacgcccggacgggtagggtagggccccaaggccacgcacaaagagacccgcccccgccggcccggggtctcggacgccgcagagcgcgcggacaagacgcgggtggggcggagattggctccgacgtccggcccagaccctcgcccggatctcgactccagggataggaccctgtccggaccgctgcccggaatgcgtcccatatctgcagccccgcccccagtcccggctccgacccgaggccccagccccgggtcccacaccccgcccactggctcaggcttacctggagcgcagcgtgggcggccccgcagcgcggcctcggaccccagaagggcttccccgggtccgttggcgcgcggggagcggcgttcccagggcgcggcgcggtgcggcgcggcgcgggtcgcagtccacgcggccgcaactcggaccggtgcgggggccgccccctccctccaggcccagcgcgcaacccgagaccccgggccagccctcccgccctcacgcggcccgtgcgcaaagcggaccgggccggcgacgcgaatctccgccccgccccatctgacagcaaattttcccattggtcgagagacccggcgcggcacggcaaccggcgccgattgggcggatgcgcggagatgacggcttgccattgggcctccgggatgtcagtcccggcggatgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacaggtatccttcttcagcgcctgctactcgctgcgcgctgcgcgccgctccctcctgtcgacatcgaattgtattcttcacgcaagccgcgagagagagttctgctgctatccccattttacagttgggaaacagcctcagagaggttctcacttgcttgaacacagtcgtctgaccctggggcctgggggctctctcatcctcacgcccctgggtccccgcagcggggagacgatggaggtaggagctgcagtatttccgagggcaggaagggaccccctcggtaaaccaggggctcacctcccccaccaggcctggatgtagagacctcttgggcttgtcccaccctgcaggccccccatggggccgccctttcttacctcctcctggcattctcacagccccacagctctgcgtctggggaggcagagttgtgcgtttatgcccgcaccccgtactactgtcccattttcttcaccctacctggagtcaggaagaaacggtgcttcactgcctgttgagattcacgtaggttacatttccttgccagattaagagcacctgacatgagtgggaccatgaccctccgccagctctgcgtaaccttgtggtgtaggggggaaccagcagggatgctgcccagtgggcttttctagggggaggtcctgagatgacttcttagccagtgaccctggctcacgcatgctgtcatcctttcctgccctggatgcacctggagatgaccagttcctcggctcattgcattctccaaggccgcctggggaaccaaactgcccacaaccatgcttatgagtggtggaggggtgtgaccagacactcttgtcttatccacccatattgggagtccagtgtgttcatccaatcattccttggccaggacaaagaaaatgaaatggcccaaggcaagaactcactgctgggaccaccgctgggtccatctgtgtgctggcagcatggtgaatcgatcccagctgcctttcagagccaggcagctactatcaatcgattggagctggcacttgacgtgccaattggcctcctggcatagggttgttgcttgctgctctgggagggcagaatgaagtagctgtccctagaataggggccctcacaaaccaggtagctgtcatcctgtggagcagcaccatggtgacattctggctcaggtgctgtgtagctgaggggtcgtttcctccatttaggagtagacgtaatgagtccagctgtccccagccatctcttcaaggccattggaccctggttctgctggagcccctcttctcacagttacctcatagtcctgcaccaccccctccccacacttgcaagagggactggacagacctctgttgaaagagtgcaaaagacagaaccatacaccaaaatctgtgcaagtgagactacctctcctctcatcaccacccctaccacccatagggttgcagagacctgtctgccctcggcaggcaggatcattagctgaggtcagaggatgtcggggcagcaccaattcaaacaggactcaggaccgctgtccagcagtcggcccattaggctgcagccaggggtcagaaacacaacaagggaggctgggcgcagtggctcatgcctgtaatcccagcactttgggaggccaaggcaggcaaatcaccagaggtcaggagttcgagaccagcctggccaacatagcaaaaccccatctctactaaaagaatacaaaaaaaagtagcggggcatggtggtagacgcccatagtcccagctacttgggaggctgaggcaggagatcgcttgaacctgggaggcggaggttgcagtgagctgaaattgcaccaccgcacggcagcctaggagacagagcgagactccatctcaaaaaaaaggaaaaaagaaaaagataagaaaaacacagcaagggagaccacagggaccagtagcccagtgttctccctctctcatcctctcacctagctccatgcggacagctgtgaggcccccggagaaagccacagagagaaaatgctttcagctgggtgtcaagaacttttcaagagtggcagctgttgaaatcaaaagagtggccacagaaggtagtgagcttcctatctgagtttgtgtgcaattagaggttggatgccagtgagcctgttgcagccccaagatcccagggcttaggtgcccatcctagacccatttcatctgccgtcacctgcttcctggcatcgcatgtcatccagactggagtgtcagtggtgacaaagaagatcagagtgtctgctctggctctgtctagctgggaaaagtatggctgggggtggggatggcccaaggccacaaggtatgacagaacaggatgcaaaccaccatctgacatgttactgcatccctctttgtgggcaaagggaaaccttggtcaactcatgtccagctttgaggtgcatggcctggtgctttggggaagcccattctccaggtgctgccatgaaccccagggcacagtccatcacccccaagccccagatcccacttgtccaccaccaccacctcttggccctatagattgcataggtttggctgctcagagggaaatcactggtaccagccccacatgatcccactgctggatggtgggagagacaaccatgtctggctgggtctgcggcccgctggccatgagtccctgggcatctggagtccttgtaaaaggttctgttgggttccaggggaaacacagataagatagcaaaagtgtggagcacaacgggcccgcatgtaggtccaggttagactcttgccgttgctgattaccagccaggctcttcccatccctgagccccagttttctgcagggcatcagggcacctaggtcttcaacacaggttgaagctaatgtggcctctcttgcttgccacctttttcaacttcaactgaatgacataactgctccaagtctcagtgtttacatctataaagtgggatgaaagaactgctgacccagacattgggtttagagtgctttacacattatcattatccctaatgtctttgtcatccatgtcatagttttttgaatgctcactttgaggcagggcctgagcctctgggctttgactctccacctttctgccacataggcccaggcacagcccagaggctacaggagcagcggtcccagctaatgcctctgtcctgttgggagggccccagtcagtgcccacctgctcaccctgcacaagtcaagctgggccagcccctcgtcgctggggcctggacctggatgtgagctcaaaggctacactggggggtggaagtgggggaggtggtgggtgtgcagggtatagtgctcaaatgcctagtccagggtctgggggtacatactgggaatggcagggacatcagggaggaaagagccgacctggaggccataaagtgaaggaagggatgaccaagaggaagatggccaggtccagaggtggggttgagtgaacaggatggggagaccaggacgcagtctgagggggccagtccggaagtgagcattcctgtacctcttccgagagaggccgcagggtgagcaggtgacagatggtgtccatgagggcatggactcaggggcggctgcgacctcccatggcgtccctgcaggcagggagccgcggagtccccgaaggccgctggatcaggaagcgctcagacgcccgcgcagcccgaagctttggcgcagccccgggggcggggcgccaggaggtggcagcctccgagcgacagcgcgcccagccaacgggacgccggcatgcggcgcgccgccccgcccctcgctgcgcggcccaatggtgaacgcgccggcttcgggctgggcggtactgggctggctgcggtggcgcgcgggcgcggcacccggaagtcggcggcggtggcggaggcggtgagtgcgcggctccggggctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgaggtatggtatagaatcaggcggctgggtcaggggcaaccacgtcgatcccggccgacgaaaatgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaatgtgggtgtgagtagatagtaagtgctgggtcatccctgcgcctggatgcggccttcctggggaggtttgggtagttagatcccccacccccaactccagagcgtcagaggtaggggctggcagggctgcactcagggcagtccttgccccaccgctgggctttgtagcagcctgggctttgcccgttttcctctaggaagtgggcacagagggctgtttgctgagacccccaccttccctgcccctagcacctctcctgtgctcccttggcttcctgctggaccacaagctttagagtgaaccgtctgcccttggacaagtccctgggcctcaggcccccttcctcttcaggaatgtcacatgccctgccctggccaggcctgtttgcactgtcgtgtggctctagacctgctgaccactgttttgctgccactctgggcacagtgccctcttccatgaggcagatgtgacggcagctataagggggtagctgagtagctctttggaaggctttctcacgctagctcatttgcctctgggcagccttttggggcaagcattcattgatccagtcctgctcatacaaggaaaactcaggctaaggtggcagatcgtgttcccaaggtcattcagagccagggcctgctcccagtgcctctactactcctgggccactctcttaggagtgtccctgtgtctgtgtcctgcgtctgtgttgggtgggctgggagcagctggagagggtgaccatgttgttagatggacacagcagagcctctgttcccacaggatcctagtgctctggtggtccagggtagggtgccctggtgcccccaccccctttgacccctacacagctttgtgttacttgcatgtcctcagactgcaggcccctcagaccaagcccctgcctgctgtgatgtgtggtggccatagcccttccctgagctaaggtgaccagctgtcagctcttcctgggctgcccagcctcttgtgcttccttggtcttcacttgtgggctgtcattctgattacgttttgcagtgtgtggaatcacgtgcagtgtcctgggaacttgatcctgtgcccggcttctgcgccagacggcgaacttggagggcaccccggtgcccacccaagggtgctgcttctgaaaacacccacagggatatgaggggcttctcagggaccccagaaggggtctggagagaaatggcccgggatagggaggctgggaagacttctcgaagtagggccatgcttgtcattgacactccagatgcatgagaagcagggcccatcctttggtgacgtgtcagtcagcacatggcagcagcatggcagagcctggcctttgttggcccctaccatagggcttgggctgtcttgaaaacaagcctatccctaccatgaggatgggctccgtgaaaacaaggtcaccccagaaagactgagctgctttttgaggttatcacagctttttcccctttttctctcaacttcccttttagactgcaaaaatagtttatgcatgcttaaagataaaaaaggctggcctccttctcccagcggctgctcccctggtgcacttgctgacatttgggggtacatccattgagatcttcagtgccatgctaacttgaaacttgaagtgcttgccttcatcctctttgcgggcatggtaggagtgcccccctttttttttgtttttactaaccactcaggccgcaggggccgctgcgaggctggcctgtccctggcttgtgaggaagctgagtgttcctcccaggagggcctgaggatggggccaccctgtgtccagagcttgctgtctgctcacgatgcctcttgtttgtgctattccttggaactgggaagagacagtgatcctctggtgtgaggctgaagaaatgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaaaaaaaaaaagaaaatgtgtcataataaaatgccatttaggcccggcacggtggctcacacctataatcccagcactttgggaggccgagacaggtggatcacctgaggtcaggagttcgagatcagcctggccaacatagtgaaaccccgtccctactaaaaacaaaatacaaaaatttgctgggcatggtggcaggtgcctgtaatcccaactactcgaaaggctgaggcaggagaattgcttgaacccaggaggcgaacgttgcagtgagagaggtcaccctctccagctgcccccagcccacccaacaggaccattgcactccagcctgggcgacaagagcaaaactccatctaaaaataaaaataaaaaatgccatttaatagccagagagtgtaaactggtgagctcttgctgcggagataggagggagcagggcattgcagtggactggagactcagagggtttcctgacgtcaggactttcttcgcccaggccccgtgaacagcgacactgtgttcccacgtgtgtttacctcctctgctgacagccaccgggagcccgcgtcacatgtctgtgtctgcctttgaaaagagcaactcgtgctttcaagctctgcccctgggggctgccaccgctgatggagtggggattacaagggatggggattgggcgcccggctgctcagccctgcagcaccagcccttgtggccattgaggccattaaatgggggcagcagactgtagggcttagtcaccctctgttcagggactcaccatgtgcagccccaataggagcccgacttgatggctaccctcccaagtgtctaggtccccttgaccctgtggtactaatagcttgccattcctctgtcaccactgctttctgcttagcacacatcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgtcttgcaccagggctgattgggtcttctcttgctttctgtgaacaagtgactcttgggttcttgcccttccttccctctcttccctgcccatagaaatgtcccagccctggcagggaaggagggcaggatctgtacattttctttttttttgcgttttgagacagagtcttgctttgtcacctcaaaaggctgaggcaggagaatcgcttgaataccggaggcagaggttgcagtgacctgagatcgtgccactgcaacctctgcctctcaggttcaatgcgattctcctgcctcagcctcctgagtagctgggattacaggcgtgcatcaccacgccctgctaatttttgtgtttttagtagagacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcatgcttactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatctctggcctctgcatgaaagaccaagcagagtgctatcttctggctgagacctccctgctgcctcatcaccatggaaaggcacaggctggcttcttttccaggttatggactttcttactgtgtcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagatccaagagcttcaccaaggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacacttaaaaccagatctcgtgagaactctatcactgtacagcaccgggggggatggtgttaaactttcatgagaattctgcccccatgatccaatcgcctcccaccaggtcctgcctccaacactgggaattaaattcaacgtgagatttggtggggacacagatccaagccaaatcagcccatgtgcagagcatgtgctagggatggtcgcttgatgggacgaagacaccagccacagctgagaggcagagcagcgggaaagctgggcagtggtgaaccagtggggacatggctctggtggagacagacctcatggccaatcagggagaacggagcaatgggaccctagcgtgttaaccccacagcatacatgtgtctgctcacatgtgtgtgcaagcaggttaagaacactctggcgccacaggcagcccttggctgaggctttttttccttttttttttgagactcagagtcttgccttgtcacccaggctggagtgcagtggtgctatcatagctcactgcagcctcaaactcctgggctcgagcaatccttctgcctcagcctcctgagtagctgggactacagatgcatgtcaccatgctcggctaattttattttattattatttattttattttactttacttttttgaaacggagtctcgcgctgtcacccaggctggagtgaagtggcacaatctcggttcacggcgccctccggctcctgggttcaagtgatcctcctgcctcagcctcctgagtagctgggattacaggcctgcactaccatgcctggctaatttttgtatttttagtagagaccgggtttcaccgtgttggccaggctggtcttgaattcctgacctcaaatgatctgcccgcctcagcctcccaaagtgcagggattacagccatgagccactgcaccctaccttattttattatattattagtattatattgagacagagtctccctctgttgctgtgttgcggaagtgcagtgacatgatcataattcactgcagccttgatcttctaggctcaagccatcctcctacctcagcctcccaagtagttgggaccacaggcatatgccactgcacctggctaattgtttttatttgctttttgtagacagggacttgctgtgtttcacaggctggacttaaactcctggcctcaaacaatcctcctgctttagcctcccaaagtgctgggatgacagacatgagccctgaagggatggggctttggcccgttaaatgtcactggaaatgtttccctccagaatgtgctcctgggtgacctgagcgatggtattaacaactatgggtcccaccagcctccagagctgccagtcgtggctacaggagactcagccttaggctggggcacagagaggctgaatagagggtgaatgaacaggcagcgtatgggagggaccagcgtttcttggtattatacaaaagctagtggaggtggtgctggttggtgtggggtgggcgactggcacggtcagatgcctgatgcctgttggcctcctcagaaggggaggctggcagtagtgggttctgggacatgcaggagggtggcctggatttgccctgcagcactgaggtctgcctgttccccactgggtcctccatttgaggccctgtcagcatggccctcgtcccccttgcttcttttccccatgggcctctgcaaggttactgcccaccctccaccccacctacctgcctgtggtgggcactgagagccagggaagcagatcctcactgccaggcagcaggccatgtgcgcatccatcagggtgccagaccttgtccccacgcagccctggctggggtcactgctgctgctgctctctgcctgtggctctggcccatctttgcccaggcgttctgtctgaatggttttcttgtcgtgccttttttagacaccgcatggagtgaggtttggggcttgcctcaactggagtctcattcttcttagagagggagtttagcccgtttccatttggccttaggacagaaggccctgttggtttctctgagaagccaggggaggagccctaggctggagaggggattctagagcggggtggctctcagaagcagaaggtgggcagagaggacggtgcacgctgggagagttctcgaaagcatcagcagatgggcccagagtgcctggaaagcttccgtccttcacagacagcgccatgctctaagaataacccatgccaagtccaggctttcttcctgttttgcagaattaccaggttgttaggctaggggaacgtatgctgggattctgggaagaattccacccgcactggtattcttagaggacgggaagcccttggctgcggtgtgaagagggctctctctttccattcatatctcatagatcctctggccaggcttgggggtgttgagggactccaggagtgtggggggaacttcctccctggaagaggcctgtgctctgtccctgctgaggctggtggcatttgcagtcacatggtgagctcacagtgactgtccccctcttacctccctggcagggttggcaaagaccacaccaaagtcccaagtgattagttccccggcctccctgcacagaggctgtgcatgtcccctgggcattcactctagctgtctgggctgcagggaggcagggtgcctggcccaactggagatggcactctactgggggtggttaagtgttgaccatcacaaaggcgacctcttttgtcacatctgtgtgagaggagctggactttctcagatatggatgagcctcacgacgcacatcctttcgtcccttgcttgtctaccaagtccctatgtgctccaggaggcagtggtacaggccagccgctccgtatgaccagagaaccagtgcctcacactccagcgcatttccttcccagggtgcaccaggactcttgtaaagagggcattctcgtgtaagcagttgctttttttttttttttttttaatttttatttttttgagatggagtttccctcttgtctcttaggctggagtgcaatggcacgatctcggttcactgcaacctccacctcgtgggttcaagtgattctcctgcctcagcctcctcagtagctaggattataggcacgcaccaccacacctggctaatttgtttgtttgtttgtttgtttgttttttgagatggagtcttgctctgttgcccaggctggaggacagtggtacgatcttggctcactacaacctctgcctcctgggttcaagcaagtcttctgtctcagcctcccaagtagctgggactacaggcgcccgccaccacgcccggctaatttttgtatttttagtagagacagggtttcaccatattggccaggctggtctcgaactcttgacctcgtgatccacccaccttggcctcccaaagtgctggaattacaggcgtgataatttttgtatttttagtaaagatggggtttcaccatgttggccaggctggcctcaaactcctgacctcaggtgatccacccgccttggcttcccaaagtgttgggattacaggcgtgagccacctcgcccaaccagcagttgctgtaaaattttttaaaaggatgtcacttatactacccagtcattaagacttcctgaggtggaaagatcacttcagcccatgagtttgagaatagcctgggcaacataatgagaccccacctctccaaaaaaatttaaaaattagggccaggcgtggtggctcatgtctgtaataccagcactttgggaggccaaggtgggtgggtcacaaggtcaggagatcgagaccatcctggccaacatggtgaaaccccatctctactaaaaatacaaaaattagctgggtgtgatggcacgcacctctagtcccagctatttgagaggctgaggcaggagaatcgcttgaaccagggaggaggaggctgcagtgagctgagatcgcgccgctgcactccagcctaggtgacagatcgagactctgtctcaaaaaaaaaaaattagccgggtgtggtggtatgcagctgtaatcttagctacttgggaggctgaggtgggaggatggcttgagcccaggagttcgaggctgcagtgagctatgatcacacgactgcacctgggcgacagagtggaggtgatgtgcttcctcaaatagccatgagaacaacgcttcttttcttgtcctggctcaggaacctcaccaccatgccacgttgccctgctgcgctgtgctggtgtcgtaggtcggtggcaggacatttgcccacctcacaggctctgctttcagtcttgaagtatggctcctctcgactgctgcccacacggcctcctgttgtcagcctgggctacatatctgggctcttccatccctgtgggcctggtgaggcctggccatgtgcctgtgtcatgccagttgctttcaagatgatgtttctagtaggaccacatgtgaacacagtgaccaccatggccaggaggaagctggctgcccatcaccagcttgcccagggacctcttgcaccctggcggggatcagcagatcctgctatgagagagcagaaggcagcatgctgacttccaggagtgtccacagcgtggctgggcagagcagagctacaaatgaacagatccagtgccgaggccatcctgactctctcaggggctgccaggccgtgggtgcagggtccagcaggcccacttgatcccagcatcccacgtgtgcctgctcggggtggccagctcactgcttcttcacctctagcccaaccagcaggtgccccaccatgagcccctccaggctcaccttgcccatccctgccatgtgacctgggactcttgagatgagatcacagctgcagagcacacagcacagggaggagctcatcagcatcttcccacctgtggtgccctggcccagcctccttccggttggggttggacccgccctggcagccaggttttgcgtcacctgccccacccgccctgtaacctacttgcccaactgctatcccggtggccgtgaggccagttgacagaatggagaggggtaagcattttccgcctggagaggatgggcgtgtggccatctgactgcttctgcaagcctggtggttgtgtgcaggctgccctggtggtcttagccccttggggcaggcggggtcctgtgcaggatgcagagactgggcgtggcttcctgcagatgttcagatgcttctgggctgtggcctctgagacccagggcaaggctgctgactggaccccagaccctcctgcctgcctcttcctccagctgctctttgtggtctggttctggccgcctgggcctcagggccaaccctgcatggctttgaccactctggccttcttggactgccaaggacatgctgagagttggttgggcttggcccaagtgctgagcccagggcaggggtggggacaggcagggcggagcctcacctggaaagccaggcacgattctccctgggacaccaaccctcctgtagagttggccaattcgggcaaccttgagggcgagctctgtgtggcacaagagatgccctgaggagcccagcctcacctggtgtgatgggacctgtggaagttgtgggaagtggtcctggccacccgtgtgcccacatgccctgcgcccagatcaagatatggtgaccaaaaggacaaggactatatccatggctccctcccagagcctggcaagtcagcaggcatgagagggtgttggaatgctgtggtgggcctgtgtggggaccttgtaggacctagggaacctgcagggcttggcttagggagcacacaggggcccaggcaaaggcaaggtcacaggtcgggggaggtgaagctggcagggggagggggagacctgctggctagagctgggttgggggccggtgggcagtgggcctggctcgagcagggggcgagggattggagagaaaggcagttcctgatggtcccctccccaggggctggctttcctctggtccttccctcccaatgaccgcgtcttcgtcgaggccacagcccttggctctgcgcccacacctccagtgccaggctgtccggagatctgtttatggccttcccttggaccatggagccctccctgccactggtgcctggagggctggtctgctgcccctgcaccctggccagctaggatggtggggtcctgcagctgaactgggggtgcctttctgcctgtctgtcctacgtgtatcagtggccagaactgccctcatccatggccttgccagcagctgggcgtgcagcccagggagggctgaggtcggctgaagttgattgagaccaacggccttctctaacaccccagaggagcatgtccctggtgagcaggccttgggcagccctgggctccaggccagtgggattccagtagagaccagctggcagggcttctccagtgactgcagccaggggttctcatgtgcaggaaagaccagctcctccagagtaaagggacttgtgtcttctggccacatggtgagtgctgggcccaccccatcagtggcaccttgggtgcactcccaaagcccagcgtgttccccatcttcctgcactgcattcgggatggttctgcatcatcagctgcacctgattgctcttaaacccacagctgagctttaatgtgcagtcactgaagctttcatttctaaaatagcttcctaagagttcttttggccaggcatggtggctcatgcctgtaatcctaacactttgggaggccgaggtgggtggatcacctgaggtcaggagttggagaccagcctgaccaacatggagaaaccccgtctccactaaaaatacaaaattagctgggcgtggtggcgcatgcctgtaatcccagctactcgggaggctgaggcaggagaattgcttgaactcggggggcggaggttgcggtgagccgagattatgccagccagcctgggcaacaggagcaaaaacaaaacaacaacaacaaaaaaaaaccgagttccttttgctgctttgtaaacccagtttgctcttcatcacttcctttgccctgcagatgtttctgagctgtctgttttctttctgccatcagagcatggttggttgatgatgcatgtacggttatctttctgctggttcttgctcatggtgcttctttcattatgtggttctttctgactatgtactgcttctggtctttgaaaaatgattttgagacttctttgaagtataggatgaaggtatctttctccagagagaacttcaggcacaggggcactacgagtgctggaaccccttaaaactgtgcttggcttgtgggtccttgtacccccagtgtggacctggacggctggctgtgccacagcttctcagaaacttcccttcacttatgtgcaatgtccccataacccctgggggtggctgcggctgtagttcatctctccctaagcatcgctctttggagtcccagcctaacttagaggagagtcttctgttaggttcttcatcctgtgggggtgactggaccttgtcttctgtctccttcgcccccgaggccaccagagtatgagccccagtgtgttcagtgggcaaacgctctcaggcaggattggccactgtgttctgctgtcctctgtgggccacgctctccgaactgttggccaaatgctgcatgagctcatcagctcctggcaatttttaagatgttttcatatttcatccagcatcttgagttgtttttaccaaaaggattgcccctagtagcctgcccaccctcggatgatggccccctgtgggcgcttccagggcacccggcaaggggacccaacccacttccagccccacagtctgcttcccacagggcccccttgcaacaacacaccctttagcttcccatcctatgcagagtggtggccagcagaccatctcaaatggctgcccatccccctgacccagtgcgtctgcacgtggcgcttattgctatcccaatacttcaactgcacagccaccagctcctcactggagcagatggtccccaatggccatccctaatgcccgtgcctatggaggcacatacactgagccctcttcacctccgtccccactcattagacttttctcagaggaatctttttgggtctcttcagtatttgaacagcttcttggctgtcccatgtcccagctgtgagcactggctctgccctggagccgtgtcactaaatcattgcacatgtgcacatttcagggaacttgggtgtcacccttgggtggcctcggaatctaatctccgttctgcactcgtttgcattgtggaaaactgcctgctctgggccccagaggtccctgggtggggacgaggtgtatgctaagtgtgcagtcacccagcgtgtccccggcacgtgtccatgccagctgctgtgggtgtgtggggccttcgggtcctgtgggatggcgagtgtgtgtgctgagcaggacctgtagggcctgcatcccaggtgagtgggccatgctgttggaggcggaggcagggctgcccccactggtggcgtgtggggtgggtttggtgctgttgcaggggaggagatgtgcatgtgggggacagtcttgaaggaagaatgtatacagtggtctatttccaagacaaagtgtcttaaattggcttagctcagcaaactacagaagaaacaggatatactaggccaccctgcttggatagctgatgtgtgcttgtcggcctccactttccccgcacttagttgccttcacccgaaccaaagaagttcagtctaagctgaaagtttactagcctgcaaaatagctcattttgtctgttcttatcagcctgcctgctacttaggtcgtaagttaaatacttaaaaagtccctgagctaactaggactgcaatgcattgtgggctgcaacaaaatacagcaagacaagcccccaaaaaaacacctgaagcccctacccaacaattaataggcgacgtccgggaaaattgtgaccccacagtactcggcctatgaggaactgggggagggacctgcgtactaggggataaattgcttgtcgaaactgtgctgggtgtgcctgtctgacacctgatcttgcaagactgtcattaaaagtctcactttcgctgttctctgggtctgagttcattctttagatttggatgggtaagtttgtttctcacagtgtggctcctgccctcacttctgctgccccccggggaccccctcggcaccccagctcggtgtgtccaggccttaagactaccatggtgctgatgggatgcttctgttcagggctggtgttgcaggtggtggagagacagtctggccagtgccaatgagtgcatgggtttgggagttgtttgtgtggcaccggccaagagtgtggtgtccagttcccccacacccagcaagtagtacagacaccacagaggtggttctctctgttctggcctgttgcaggttcggagggcagccctgagtgtctgccatccgctcaactcagtgttttccttttcccgcagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggtaggacagaggagtgacatgggtccaggtgggctgcagttctatgggctttgaggagggtcgggcggcagaactgggacaacggcgtcagtgagtgagagccagcttgggctggcgggtcacagctgctggtgagaagtcaaagtggcggccaggctaggggtctgtgggtgggtcctgagctgaggaaaaagaacctggggaagaggggacgctgaggaccagccagaggagtcaggaaatcgaggccagaagccacccctgaccctggactcaggacggccacacctccattccccaggacaccccagcatttatccacacagagaacgaggcagagatataacccacatctaaaatgaaacgtgtaaccactctctaatgcaactgctcgggaagttttcatcattttaaaatctgtaccagaaatgatttgaaccatttcaagagggtctcagatttgagtcactgcaaagttgcatagacaccatgctgcttgacttcaaggctgagtgaagtcatttcaggccaaggaatcaggaaggaagggtgtctggtgttttccctttttgcagttgggtgagtggcaggtcccagcagcagacagcatgctgcagggaaggtggaagaaatgttaggaaagaactattgactgctacagggactggagtagtgttgggctggctagtgagtgaacagaactctaaagaatgtaggggctggccgagcacggtggctcacgcctgtaatcccagcactttgggaggccaaggtgggcggatcacaaggtcaggagatccagaccatcctggataacacatctctactaaaaacacacaaaaaaattagctgggcatgggggtgggcgcctgtagtcccagccacttgggaggctgagacaagagaatggcgtgaacctgggaggcagagcttgcagtgagccgagattgcgccactgcactccagcatgggcaacagagcgagactgcatctcaaaaaaaagatgaaggtaaaataaggtcatgtgggtaggccctaatcaatgtgatgggtgactcagatacgcacaggggaagctggtgtgtatacagagatagaagcagtcgtctgcataccgagaagaccctcaaaaggagccagccctgctgacgccttgatcttggatctccagcatccaatgctgcgagacaatagtgtctgttgttgcagccgcctggtctgtggtgcttagttacggcagccccaggaaactagcacgctgaggagagccagccagctctgtatgcgtttcagggctgcctcctgcaggctgctgaagagactcaacccaccccgagtgctcccatctctggaaaggaagcttgatggctggcctgcgggtgctggtcagtgccacccagccccttgggtggagaggaggagggttgacatgggcccctcttgctttcactcagaacccgtgtgttgctgccaggacctgtcctgcgggtcctgccattccagttggcctcgggatttctctggactattttccgaagccctaagccaaagacgaaatgtgccacctctgggtgactgagcaaatgtgcgctgtgttttcctgacttcatgggagggtgtgagacacttctggtggctgcttctgctctgcctgtggggtgtccagccaggggaagggcacgctgcaggctgggagcacagacacttctatggagcccctgacagcacctctgcagcactttgggaggcctcgtacaggtacccagctaggctgggctggactcctcacctgtggactggagtaaaaagtagggtgctttaggccactatgttttttttttttattattattattattattttagagacaggatcttgctctgttgcccaggctggagtacagtggtatgatcatagcttactgcagcctcaaactcgccggctcaagcgatcctcccacttcagcatgcctaagtaactgggactacaacaccatgcccggctaatttttttttttttggtagagacaagttctcactatgttgtccagggtggtctcgaactcctgggcccaagtgatcctcctgcctcagcctcccaaaatgctgggattacatgcgtgagccaccatgcccggcctcggccactgtatttggtaatttgatacccatcacggaaaaccaagaccctgcagcaagataacacaatcacttcatgatgtcaccctatctctttcaaaactgcctgtttacagccgggtgcggtggctcacgcctgtaatcccagcactttgggaggctgaggtgggtggatcacttgaggtcaggagttcgagaccagcctggccaacatggtgaaaccccatctctactaaaaatacaaaaattagcctggcatggtggcgcacacctgtaatcccagctattagggaggctaaggcaggagaattgcttgagcctgggaggcagaggttacagggaactgagatagcgccactgcactccagcctggatgacagagtgagactccatcttaaaaaaaagaaaaaacgaaaaaaaacctgcctgtttacagccccacgtgatgccacttgctggcttcagcctagagtggctgcaggacaagctgttactccatgggacagcttccatggggtcaccactgagggtttgatcactggatctcaggccagagtacctcctatctgtcaccaaactgtcccccagacagtgcacacactcaccccccggcagaacacactcaccccccgagatgatgcacataccccccggacagtacacgcactcaccctgcctagcagcgtgggtgtcaggtggtgatggataattagtggtttcagttattggaacaaaataaagccgaggtgacttgccatcctcagggacctcaccgtggtgggtgcatccctgtctctctggacgtggggcgcagataggcttctacccatgtgcagccccaccagtgatgactgagagagctacttcctcctccctttggggcttgatctgggtgctcagcatgctggcttgtccctgaattatgtattcaatgaaatccctggcaaaccaccagcaattcagctaaacatgactgctggaacaaaaataacctggcaattaatgttcctgagttattaggcaaacatatataattgctccttgtttaaaaacagacagctgaacatcttaggacaaaagtccatgctcagtcagcttttcttcctacttttctcccctttattttccctttgtaagagcattatgtcagaatcagcacccgaagccaacagccccagcctggtttggggctggactgggatgaggtgtccctggctcccccgacccctgttcacctgcagggctgtgggacgtggaagcagaggaggaaggtatttaagagagaatgctgagcagaaccacatggagcttgaccccacccatagggtggaggagctgtcatcccagaccctggcacatccccaccatagcactcagggactgcggtgttcccccttctcctgcccgctggccaggacacaaccaatgggcacctacaggactggcccatccaggtctggggcaagtgcactgccttctactagcactgtccagcccagggaaggtgggctctcctgccatccctgctgcagaggttggggggcacttctgcccagaagggacatggagacttgggctgggtctgggttgaaacatggcagttagaggtacaaaggctgaggctcatcagggacagagaccacctccccctaccccaggcagcacatccctgagacctggtgcagccctggggccagctgggtgtcagaccaggctgaatggggcaccctggaggtggtaaggcttccatagcagaccccaagggctctagggcatggcacagtccctggcaatgaccaaaagcatttccccagttctgctggcaagaagcttcaggggcaggcactgagtggggggcacacatgtgcacacaggtgtgaatgcctccaagggcatgaatggtgggtgctagcaccatgtacttttttgtttgaaatggagtttcgttctgtcgcccaggctagagtgcagtggcacgatctcagctccctgcaacctccgcctcccgggttcaagcaattctctgcctcaacctctcgagcagctgggattacaggcgcccgccaccacacccggctaattttttttttttttttttgagacggagtcttgctctgtcactcaggctggagtacagtagcatgatctcggctcactgcaaactctgcctcccgggttcacaccattgtcctgcctcagcctcccgagtagctgggactacaggcgcccgccaccacacctggctaattttttgtatttttagtagagacggggttttaccgtgttagccaggatggtctcgatctcttgacctcgtgatcctcccaccttggcctctcaaagtgctgggattacaggcgtgagccaccgggcccggcctaatttttgtatttttaatagagatggggtttcaccatcttggccaggctggtcttgaactcctgacctcatgatccacccacctcggcctcgcaaaatgctgggattacaggcatgagccaccgtacccagctgtgagcaccactttcactcccaattttatgaatgtctgttatttcacatttaatcaggagcaaatgttgttttatgaaattgatgtgcaatgatcaatatggaaattatttttaaacacttgtcgggctctcaccactgcaacttggtttcagactcagattgtgatggcaggacagctgagctctgctccttggagctgcctctccggcacaagtgctcagggggtcttcagccatcactttttttttttttttagagacagggcttctctgttccccaggttggagtgcaatggtgcagtcacagttcactgcagcctcaaactcctgggctcaaatgatcctgctgcctcagcctccccagtagttgggaatacaggcatgcaccaccacacctgactaatttttgtattttttttttgtagatatggggtcttactttcttgcccaagctggtctcaaaactcctagcctcaagtgatcctcccactttggcctcccaaactgctgggattacaggtgtcatccactgtgcctggcccagccatcgcttcttagaccctcaggtctaatggacattgcaggaactgaccccttccactcagtcactgctgtgtccttatttgttttcttctaatgtccaagctgggacttgaaagtcagttttctttcctcaagaccagggctcttaaagtttagatgtctctcctaattccaaaagaaatatttgtttgattaggctggatgtggtggctcacacctgtaatcctccgcctcggaggccgaggcgggtagatcatttgaggtcaggagttcaagaccagcttggccaacatggtgaaaccccatctctactaaaaatacaaaaaattagctgggtgtggtggcgggtgcctgtaatcccagctactcaggaggctgaggcgggagaatagcttgaacccgggaggcgggagttgcagtgagccgatgtcacgccactgcactctagcctgggtgacacagagagactccatctcaaaaaataaaaataaataaaaatggaaatatttgtttgattcataatgcaaaaaaactagtaaaacagtgaagttcccatccactcccaaccaacccgagaaattaactccaaaacacacagaatggagcagccctcagaggcccacatgctgtgccattcaatctgtatccttgagctcacgcttccaagagcccacgggtttgttgtgggtgttcccagggctggggacagatggacagaaggaggaacagccccccaccctccagcctgggctcccggcatggagcccaggctccatggtgcccctaagggcctggcagacccgtctcccgccattgaatggtgtggatgtgtgtccctgcctagcatcctcctgtttcccgtgcggtcccagctgcaggctcccgagagctcacctggagccacggtgctccttcctccagtgtgggtgcagcaggactgccggcttcctgccctctctgagactggcccttgttgccactgaggccagttttgtgtgtgaaaagagaaaaagacttggctcgctcgtttccatctgaagccatcagtgatgctttcctcttgcaggctcatcttggcagccaacagggatgaattctacagccgaccctccaagttagctgacttctgggggaacaacaacgagatcctcagtggtgagtcttcctgcgtgctcagcggtggctgcgccttgttgcttccctagcccctgcgtggcccgagtgaccctaactgagtggtgctgcttccaagtgtgatggcggggtgtagaggtggaactgatggggctcgtggtcggggccagccccagcaccgggcattgccagagctgcccacccagcactgtctgcgtggcttcctgtgccatgcgtctgcatgggggccccatcatgtgaaagcatcagttggttttatatggatccctcctttttgctgagggcatgtgggtggatttgtgtgatgtacagatccacactcagtcactttgtgaagcaacccagtcatatgagtgtgtgcatgcgtgtgtatgcgtgcgtgtgtgtgcctgtgtttgtgtttctgtttgtatatgagcacccttgcttcagggatggtggggctgagtttgggaagctggtggtgctgaagccccgtcacctgcaccatgcctgtgttgcattaggtgtacttatagggcagaagtaggggtgagaaccaggtcctccccaccaaagataccagcctcattgaagtcctgttggacaggaaccagttcctgcccatggggtggtgggagtctacctggaaggtgcgcatagatggctggtgaggccacgggttactctgcctgcgtaccaggcgccaagtgggcccgaggcatcctggcatgctccagggtgcccactcaggccagatgtgtgacctcgtgggcccatggaggctgtgtgtgccctgtgctgcctcccaggccgggagggcaggtgttgggattataggtgtgaacccaacacttaaggaggctgaggcaggaggattacttgagcccaggagttcaagaccagtctgggcaacatggtaaaaccctgtctctacaaaaaaaaatacaaaaattagccaggcgtggtggcatgtgcctgtggccccagctactcaggaggctgaggctagagaattgcctgagcccggaaagcagaggtttcagtgagctgagattgtgccactgcactccagcatgggtgacagagcgagaccctgtctcattcaatcagtcaatcaatcaatcaaataaaagctcagctgtggggttttgtgaggactcctgtgtaggcctgtggcctggcagtagtgtgagaatgctgctgaggctgggtggtcccggcaccgtgtgggaggaggacgggtgcatggagactgaggcagggtggtcctaggcctgctggtataggaggatgcagtgggtgcagggctggtcaggacgggtgggtgaaggcacaagactgatgtccttggaaggtggaaggttttcatagatgaagatgtggcggctcagagggttaccctcttctggttccttgactattgtgccctcctgggctccatcccaccctggcacccaggtctgtcagctgcctctgaactagtgccaaccccagcagctccagtcttgtggaattgttcacccctgtggtgttttgatggtggcagctggtgcatggatgtacacgggcttctgccaagtgtcggggtgaccatatcactaaggcccacatcctctcactctctggcgtcaccggattgtatgcaaaagtttaggacagtggttctccaggtgtggtccttgggcctgtagcaccagctttacttgagaacttgttagaaatgaaatcaccctgggccggtggctcacacctgtaatctcagcactttgggagtccaaggcaggaggatcccttgaggccaggagcttgagaccggcctgggcaacgtagtgagtccctgtctttacaaaaaaaaaaaaaaaaattagccagctgtggtggcatatgcc

SEQ ID NO: 260 - DNA, 2762447 bp, Homo sapiens (residues 1,381,225-2,762,447 of 2,762,447)
  misc_feature (526527)..(526527): n is a, c, g, or t
  misc_feature (526547)..(526547): n is a, c, g, or t
  misc_feature (526549)..(526551): n is a, c, g, or t
  misc_feature (526553)..(526554): n is a, c, g, or t
  misc_feature (526556)..(526556): n is a, c, g, or t
  misc_feature (526651)..(526651): n is a, c, g, or t
  misc_feature (526655)..(526655): n is a, c, g, or t
  misc_feature (526661)..(526661): n is a, c, g, or t
  misc_feature (526671)..(526671): n is a, c, g, or t
  misc_feature (526698)..(526698): n is a, c, g, or t
  misc_feature (526702)..(526702): n is a, c, g, or t
  misc_feature (527906)..(527906): n is a, c, g, or t
  misc_feature (542313)..(542313): n is a, c, g, or t
  misc_feature (549022)..(549022): n is a, c, g, or t
  misc_feature (549028)..(549028): n is a, c, g, or t
  misc_feature (553784)..(553784): n is a, c, g, or t
  misc_feature (553788)..(553788): n is a, c, g, or t
  misc_feature (553836)..(553836): n is a, c, g, or t
  misc_feature (1857819)..(1907818): n is a, c, g, or t
tgttgtcccagttactcaggaggctgaggtgggaggatcgcctgagcctggaaggtagaagctgcagtgaaccgagactgagccactgcagttagcctaggcaacagagtgagaccctgtctgaaaaaaaagaaaagaaatgcaaatcaaaatcattaaattcataaaaatttggccatcacttctttttttttttttttttttttgagatggaattttgctcttgttgcccaggctggagtgcaatggtgccatctcagctcaccgcaacctccatctcccgggttcaagctgttctcctgcttcagccttcctaatagctgggattacaggcatgcaccaccacaccaggctaattttgtatttttagtagagatggggtttctccatgttggtcaggctggccttgaactcccgacctcaggtgatccgcccgccttgtcctcccaaagtgctgggattagaagcatgagccattgcacccagcggccattactttttcaagtagtttttctgtcttctctctcactctctccttctctccagttacacacatatattagttcacttgcccttgtcccacacctctgcgatgctctctgcgtacttttctcggtgcccctagatcttgaggttttccagcctggtgtctgggagccagccctactccctgccctgtgtgagcactggtggttcttgccccagtgtcatatagtctcctccctgagatgctgatcagacattctctgtgtagctccttcctctctggacttttgtgccactgtcttagttcgtttgtgttgctctaaaggaaaaagctgagtctgggtaatttttttctttttttttgagatagggtctcactctgttgcccaggctggagtgcagtggcacaatcctgtctcactgcagcctctaactcctggcctcaagtgatcctcccacctcagcctccctagtagctgggactacaagtgcacatcaccatgcccagctaatttttaaaaataatttgtagcgacaaagccttgctgtgttgcacaagctggtttcaaagtcctggcctgaagtgaccctcctttcttggcctccgaaagtgctgggattacagataataagccatggtgcccagccaaggctgggtaattttttttttttttttttttttgagacagagtcttgctctgtcgcttaggctggagtgcaatggtgcgaccttggctcactgcaacctccacctcccaggttcaagtgattctcctgcctcagcctcctgagtagctgggattacaggcacctgccaccacaccctgctaatttttgtatttttgtatttttttattattattctttaagttctagggtacatgtgcagaacgtgcaggtttgttacataggtatacatacatgtgccatgttggtttgctgcacccatcaactcatcatttacattgggtatttctcctaacgctatccttcccccagcccaatttttgtatttttagtagagatggggtttcaccaggttggctgggctggtctcaaactcctgacctcaagtgatccacaaggctgggtaatttataaagaaaagaggtttatttggcttagagttctacaggggacctgaagcacagtgtcagcatctgcttctgatgcaggcctcaggaagcttctactgatggtggaaggggaaggggaggtggtatgtgcagatcacacacggagggaggaagccagagagagggaggaggcgccacgctcttttaaacaaccagttctcaaaggaactaatagagctagaactcatcactgtgaggacaacaccaagccgttcatgaaggatctgccattaggtagatctgtctcccattagaccccacctccaacactggggatcagttttttggtttgtttgttttttttttttttttttgagacagagtttcactcttgttgcccaggctggagtgcaatggcacgatctcggctcaccacaagctccgcctccaaggttcaagcaattctcctgcctcagcctcctgagtagctgggattacaggcgcctgccaccatgcccagctaattttttgtgtttttagtagagacggggtttcaccatgttggtcaggctggtctcgaactcttgacctcaggcaatccacccgcctcagcctcccaaaatgctgagattagaggcgtgagccacctcacccagcccggggatcagattttaacatgaggtctgggggacaaacatccaaactatggcagccatgaactctggttgtcttagtttccccaaacactaagcccctcttctcagctcagggagtctgctgaattcggcctggtccccccactccctgggctgggtcctggagcctctctaatcatgggctcactttgtttcctgtctgtcatatccttttttgtaaaacccatttgatatggtttggctgtgtctccacccaaatctcatcttgaattatagttccccaaatccccacatgtcctgggagagacccagtgggaggtaattgaatcatggggcattacccccatgctgctattctcatgatagtgagttctcatgagatctgatagtgttttgtttttttttttttgagactgagtttcgctcttgttacccaggctggagtgcaatggtgcgatctcggctcactgcaacctccacctcccaggttcaagcaattctcctgcctcagcctcctgagtagctggaattacagccgcttgccaccacgcccagctaatttttgtatttttagtagagatggggtttcaccatgttggccaggctggtctcgaactcctgacctcaggtgatccgcctgcctcggccttccgaagtgctgacattacaggcatgagctgccgctcccagccaagatctgatggttttataaggggcttttcctgctttgcttggaacttctccttcctgccaccatgtgaagaaggacatgtttgcttccccttctgccatgattgtaagtttcctgaggcctccccagccatgctgaactatgagtcacatatctttcctttataaattacccagtctcgggtatgtccttgtagcagcatgagaatggactaataaatacaccattgtttcttgagttttatttatttatttattttttggttgttttatgcaggagggtaaatctggtccttgttgcttgggcaatttggaagttttgttcttgttttaattattgatttgtaagagttatttacccattctggatatgagtcctttgtgcctactcatttccttaatgatagcttatggtgagcagaattttttttttttcttttgagtgggtggagtcttactctgttgccaggctggagtacagtggtgcgatctcagctcactgcaacctccgcctcccaggttcaagtgattcttctgcctcagcctcctgagtagctgggactacaagcatgcaccaccatgcccagctaatttttgtatttttagtagagatggggtttcaccatgttggccaggatgggctcaatctcttgacctcttgatctgcctgccttggcctcccaaagtggtaggattacaggcgtgagccactgcgcccggccagaatatttcattttaacaaagtacagtttatcttatcttttatgagttgttctttttgtgccttatccaaaaagtctttgcctacccagaggaaaatatataacaatattttcctccatttgcttctagaagcctaatttttgtttttatgtttggtctatgatttatctcaaggttttgtacatggtgtgaggtaggggttgagatttactgcctccaacccccaaatctctctagttgttccagcatcatttattaaatggattatcttttgcctagttcattactatggcaacttggttgtacatcagttgaacatatatgtgtgggtctattcctgactctgttgtatcccattgatctatgtatctgtcttgatgccaacaccatgcagtctatgagtgctgctgctttttagtaagtcttgaaatcaggctgagcactgtggctcacacctgtaatcccagcactttgggagaccgaggtgggcagatcacctgaggttgggagttcaagaccagcctgaccaacatggagaaaccccgtctctactaaaaatacaaaattagctgggtgtggtggtccatgcctgtaatcccagctactcgggaggctgaggcaggagaatcacttgaacccgggaggcggaggttgcggtgagctgagatcacgccattgcactccagcctgggtaacaagagcgaaactctgtctcaaaaaaaaaaaaaaaaagaaaaaagaaatcaggcaatgtgggtctgccttctttttcgggactattttggccatcccagttcctttgcatatgcatagatatttcagccagtctgttaattgctataaaacgaaaagccccctgggattttgactgggcaggttttgaatctatgggtcatgtggggagaagtgtcaccttaacaatactgagttgtctaagaagtacccagtgaaacaaataataacaagaagaaacactgttgaggctgggcacggtggctcacgcctgtaattccagcactttggaaggccgaggcgggccgatcatgagatcaggagaccgagaccatcttggctaacacggtgaaaccctgtctctactaaaaaaatatgaaaaaattagctaggtgtggtggtgggcacctgtagtcccagctacttgggaggctgaggcaggagaatggcctgaacccgggaggcggagcttgcagtgaactgagatcacaccactgcactccagcctaggcgacagagcaagactctaaaaaacaaaaacaaacaaaaaaacactattgaatctttcagtgaatatgcatgtctctccttaaatcaggtcagctcaacttgagaccctcaacagtgccctggagttttcagtctttgtcactcatttttcattaaatattttcctggtggtttttttttttttttttttttttgagacggagtcttggtctgttgcccaggctagagtgcaatggcgccatctctgctcattgcaacctccacctcccgggttccagcaattctcctgtctcagcctcccgagtagctggaactacaggtgcctgccaccatgcccagctaatttttgtatttttagtagagatggggtttcatcatattggccaggctggtctcgaactcctgacctcgtgatccgcccgccttggcctcccaaagtgctgggattacaggcgtgagccactgcacccggcttttttttttttttttaatcacactaaggattttaaaaatgctgttataaatggtatatttaaatgctcactttccagttcttgctagcatttacttattagttctaatacatcggttttggtattccttttgggttttcttcatatatgatcctgctggttgcaaatacagttttgttgggttttttttttttttttgagacagagtttcgctgagagtgcaatggtgtgatctcggctcactgcaacctccacctcccgggttcaagcaattcccctgcctcagccccccgagtagctgggattataggctgcctcagcctcctaagtagttgggattacaggcatgcaccaccacgcctggctaattttgtatctttaatagaaatggtgtttctccatgttggtcaggctggtcttgaactcccaacctcaggtgatctgcccgcctcggcctcccaaagggctgggattacaggtgtgagtcaccgcacggggccacaaatacagttttatttctttatttttgatctttacatcttttctttttctgttataattaattattgttataaaaataatatcttagggccaggcacggtggctcacacctgtaatcccagcactttgggacgccaaggcggacggatcacctgaggttgggaattcgagaccagcctggccaacatggagaaactccgtttctactaaaaatacaaaattagccaggtgtgatggcacatgcctgtaattccagctactcaggaggctgaggcaggagaatcgcttgaacccaggagggagaggttgcagtgagccgagagcacaccattgcactccagcctgggcaacaagagcgaaactctgtctcaaaaagtaataataacaataataaataaaataacatcctagccagtgcagtggctcactcctgtaatcccagcactttgggaggctgagtcgggaggatcgcttgagcccaggagttcgagacaagcctgggcaacacagcaaaactttgtctgtacaaaaaaatgcaaaaatcagccgagtgtgatggtacctgcctgtggtcccagctacttgggctgaggtgggaggatcgcttgagcctgggaggtggaggttgcagtgaactgtgtgattgccactgaactccagcttgggtgacagagtgagactctgtctcaaaaaaataaaaaatgaaataaaataataaaaataacatcttaatgacagccttttttgccccaatctttgggtaaaatgaccccctggtctaagaaggagccctcctgtggctttcagagccctccaaccttgtggcattagcagtggcccatgccctgcagatttggcgggggtgaaggtcctggttgtgtgctgggctcctagtgaagggcctgccctttgggcctggtgcatcctgctgggtgaggacagccagcgtccctgcaccccattcatgcgattggagcctagtgctgcccctcagccttgacgctggcccaagtggaaggatgtgttctgcagggcatctgttgggataggtgtggttggtgtcatagttgtcctgcaggacagggatctcacttgcacgacccatgaaccccaggggctgcctggccttgaagagttccagccacgattccatagctggggctgctgggccaagccgcatgtcgaacgtcctcgaggagcttgaggcaggagctgggccgagtatgcgtctcccagggctgggaaccaggtgggggactggaatgggtggcatcaatggtggtaacactgtcatctgccacagggctggacatggaggaaggcaaggaaggaggcacatggctgggcatcagcacacgtggcaagctggcagcactcaccaactacctgcagccgcagctggactggcaggcccgagggcgaggtaaggcgagtggggtggggccaaggtgagacagggtggggtggggcaggcctaggtgagacaaggtggggccaagggactacaggactggccaatgtatggtggagtggggcgggccaaggtaggaagtgccaaggtgcttgtgcttgggagtgggatggggcagggctgaggtaccgtggggcagggccaggttacagagtgggcggtgacaaagcgtggcagggcagggcccaggtaagggtggggacaagaagggggaagctgggccccgtggcaggtgggtggcttccgtgggcatatcactgccgccactgaggtgtgctgcaggggtatgcggcagagacaggaagagtgaggaggggagcatcccatttcccacaccctggccctctggcgtcgcagccaggagcccactcccacctgacccacgcagcactgtttactcctctcagggcgcactctccccttgtcctcatgcatggcactcctgactgctgtgtcactgtcccctgcctggaatgtttgtagagtagatgccttccccgagacgacagctctgtggacacacattgtccccactgaaaggtgttgtttacttcatgctggatttccataggaagacatagtggggaaattttttttttaataaaatgagcagttttcagtgccgacctgagtggcagccaggctaatgaggtgtggctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtggcagagcccctgtgctctctgcatgcccccatgctcaggaaccacttttcccggtcagtagttccatgtgggtctgattagtctcaggagagttcctctgcggccgtggcaccagcaggacttggcactcagcagctgtgtggaggtggggtgccaagggtgccatgccttgagcagatacacgggctcctgtggttgggggttgggggtttgggctcctcagagcctgtgcaactctcccggctccaaaggctgcagagtgagggtcagcctcctggacctagcctgaggatacaggcagtggccaggagagcataccacaggtcaggcaaaagctggtgccagggccgaggctggagggcgggggcatcggaggtcagtgagcagccctgctggtaggtgcagatgaggaagccaaggcctggaagggagagaggcttgtcatggccacagctatccctgggtgaggcctgccctccgcctggcctgtggtatagtgctggcagcatgggtgtccagttctgtaggtccttacacagaaagcccagaggagatttttgcctgcaaacagtctctgaaattatgaaccaagtatcttaggaaagttgccaaagaccatggtgaggaagaacgggagtggaatgtgaacatagacgggggggcccttgaagcctaccaggggtggggaaggtgggtcccacctgggggcagcacttcggggaggaaggcaccatgcctggctctttctctgcatctgttccatcttgaaggcccagggctccatgcccagcatctggcctgggagggcatctcacaggccacaaagagatcctcttcactttgcaaaaaaggcactccaagttctagaagacttactgtggtattgaggattggaatattttcagctggggagcattttgaactattttctttttaaaaaatgatttatttattttgtagagatggggtcttgctatgttgcccagtctggtttcaaactcctggcctcaagcagtcctccctccttagtctccagattagctgggactataggcatgagtcactatgcccagctctactgtcccttaactattttaaagtgtacacttaacacttgagagtaggaaaatgtggtctttggcgctttctttggaagcctcgatcaccctggggccacactggggccacctgtccagaaaccctcatagatgagctgtggtaaggggcctgatggagaggttggtgatgtggggatggggctcagccctgcagttgtccccatgggcagcctctgtgtgtccatgccatggggcattcggcatggcaggagggcattttagatcctgtgcctcctgggctggtgggccccgaggtgagctgggaacatacccgtgatgctggacaagagctggggcctccatgaccccgcctgccaggcacctgaggggctgggtcctgcaagctcctgacctggccgcagcgggctactgcgcacatcgctagcctccagaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtgcctgttccttctcagaacctctggagccatcaccacctggggttcttgcctggtctgctccctgacgcacaagtacacaccccactcaagccccacacagatgcacgcctcctgcacccagtccccagtctgatccccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccacgtggcatcctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacccatttaaagtgtatcattcagtaggtttcgtttcattcacagagttgagcaactgtcatcactacctaattccaggacatttcttgatccccaaagaaagccatacctgtcagcagccactccccattccccgtctcttcagcgcctgcaacctttaatctgctttctgtctctggatttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaaccctcgagccagttggtactttttgtttcttccctttatccattaatggacacttgagttttttccaccttttggctgttggaaacagtgctgctcacagtgtgacctcacagcatttgtgtggtcatatgtttttatggctctcatgtgaatacgtaggaatggagttgttaagtcgtatggtaaccctgtttaaccttttgaggaacatccaaactgtttgccaaagcagccgcagcattatacattcccaccagcagtgtatgcgggttgcagcttctctgaatcctcaccaaaacttgctatgttctgtgtttttgatgatagccacgatagtgggtgtgaagttgtgtggactcgtggtttggtttgcgtttctctgatggctatgatgttgagcagctattctcatgctcgttggccatttgtatgtcttctttggagaaatggttattcagactgggttgtctttttgagttataggagtgacttatacattcattctagctacaagtctcttatttaaagcacaaagcttaaaatttttaagtcctatgtctctctctttttttttcttttgttgctcatgcttttggtttcttatctaagaaaccattgcctaatctaaggtcatgaagctttccccaatactttcttcttagagttttatagcttttgctctttcacttaggtctttggtttgacttaagttaactatttttttttttttgagacagggtctggctctgtcacccaggctggagtgcagtggtgcagtcatggcccactgcactgtcaacctcctgggcttaagagatcctcccagccgggcgcggtggctcacgcctgtaatcccagcactttgggaggccaaggcgggtggatcacaaggtcaggagatcgagaccatcctggctaaaccggtgaaaccccgtctctactaaaaatacaaaaaattatccaggcgtggtggcgggtgcctgtagtcccagctacgtgggaggctgagacaggagaatggcgtgaacccgggaggtggagcttgcagtgagccgagattgcgccaccgcactccagcctgggcgacagagtaagactccgtctcaaaaaaaaaaaaaaaaaaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatttggggtgcttggctcccatcaagcccacccctgctgccctggcctctagagaagagcctctgaggtgaggtgcttctccacctcaagtccctgcccttcactttctgtgacatgagaaacccttttcctgttggccatgccttctgccaacactctgggagcttgttcagagtctgtgcagagccccccggctctcctaacctggggcctggctggtacgcagaggtgggccatgctctgctgaggcccagcctacacctgtgcccactgtgtggcgctgttgggggttccccaaacagggacatgattgtggtgggtgcctcctggcctctggtggctaattctcccactcttgaacttctcaggtggccccccaacctggcgtgaggtgaagaggttccctcttggctgtcccctttgcctgtgagatctcaggttgctcatttcttattcatccatccatcgaggctgctgggcatctgtgccttgtggtctcctgtgggtgcccgcttccgcctactgctgagttctcctctccttgccatgccatcaggtcaggaatgagcatggggaaggagctggagcatggagcggcttggcctcagtctggcctgatttcatggtccccagctgtaccccgtgttaggtgggtggcaggtggcaatttgccctgacatggcacagcagggcctctgcatggcccgctgattgctcctcacaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaacaccagggacttttgatgacagaagatgggcccaggcccaggcccaggcccaggggaggctcagtgcacccagaggcttgatgcagccacgtggggcccagagcagatggatgctcccctctgcatgccgagagcttgtgggaagttccagaagattctagacactcagcaaacccaggcggaagagacacatcatggaaatgagtggctagggtcagcacgctcagggttgatgggcttcccgcaagcggtctgtccccagcgaccctgggctgagtgctgggcagggacttgcagttccgggaactgcctgggtgtaggagctcccacccacttccttgcccgtaggcctcaaggcccctcaggggccaggcactggggtcttcgttgccccagccgggggtcctggtgcttgccatgccagcctttctcccactgggcgagatgccccacccatccctcgctccccacccaggtcagaccactgccctgcccaggtgatccagcgtccactcccaccctgtccagcttgcccccttcagagaagcacccatggaccatctcccactcctccccctggggcccctttctgccccctgcctaccctccttctcctctgggcctctgataggcggcctcgtccttcagcctcagcatcgctgcctcactggaagagccccacctgggcatgcccagcagcccctcccagctgtaagtccacacagcccccatcaatgtgccatctggggcaggccgaggaccggccctggctgccctcactgatggctggagccccgatgctagctacaatggctggcttgagtggacttctgtcacagaggcaaatgcccacagggcacctcttggggcaggcagggagcttgtatgtgccatctggggccaaagctccacgattgagtcataagttaagggtagatggagattttccgccttgagcagaaacgtggaggaaacacgcctggtgtgtgactcacgcctgtaatcccagcactttgggaagccgaggtgggcggatcacctgaggtcaggaggtcaaaaccaacttggtcaacatggtgaaactctgtctctactaaaaacacaaaattagatggctgggtggtgcacgcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaaagaaaataagagaaaagagaagagaagaggaaaaagaaaagaagaaaagaaacaacccttgcagttccccggccactccccagagccagttaggccaccaggtgggctggggctagacccggctgcgggcgggccacagagggactaatggccaccacttctctccatcctgcaggcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcagggtgagcagataccacaggctcccggggccccacaggctgggcttaaggagccagtacacagccacacagggccaggatggcttcagggctgcctgcacattggtggatccctgcgggcaaacgccccggcaccatggcactaggcctgcaggctgtacccttgggtggtggctgctggccagcctttcctgcctggggctggctggcccattggcaggtgcagggtgtcatttccttcagcccctcctctgtcataggctcatcttcctgtgtgtgaggggaaggcaagtgccaactccactccctggcaggccgcatagccgctgggtcccaccccacggggtgcactgcgtatgtgtctgccctgggaaccagcctgtgctggggctgttgggggatccagggccaccctccgtctgcaaagcccacggcagagagggttggaggagaggagagtgtgctgaatgtttgcttcaggtgggctggcatggcctgggcagtggaagagagggcacaggagggaagccttccagacagaggaggcctgggccccaagtggtcaacagcttgacctcttggaagaaccaagcatggctgtgtctgggaacctgggcctccaaaggggaagtgtgtggtcagcccgcaggctgccctatgccttggctcatgctacacggggagagcagggcagggtggggtggttcccagtgaaggtggcaggactcagcaagtgtgggcctgtggagccagccaagagctcacacgccactgatggcccctcatcatccccaagactgaggctgctgctctctgtgacttggcacagcctccaggcatggggttcctaactctacctgcctgcattcttgccctatttgtggctgtgacaggcagggcagggctgagggacaccaggtgaacgagggcccctgctctctttcagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccccactggagcgggaggcaggctggcctggacttctgttggatgatgggggccaggggatggtaggaggggcaggagagcaggtctgcatctgtctcagccccaggagctcctggtttggggccagctctaaggagcttcatccctgagcctggccgagtataagggggtcccggatatccaatgctgagacctagacttttctaagcctctgcacccaacccctaacttggccttttcagacccatgagagtgcagggtgggtgtggacctgcgccagggcttcccagcctgattgtgacatgatgtgagtccacctagggaggagcaggggcctccccgtctcttccccttcttgcccagaccactttgctgggctcagagccttccatggctcactttgaactcagaagagtttcccagctgcgacccaggctgcacccccaggcctgaggagaaactgaggccccacatcccatacgtgtcctctgagtcaggacaacaggctcccggctgggggcactgcccttgctgccaacacattcacctgccccagtggctaccatgtcctgtgccggtgaccagtgccagtccccaacctggatggtgccctgccctcatgaagagccccccggatgttcacctctgcccagagacccggcctgcccaggaagagcagtctctgctcttgtgtgggtccctctgcccccaccctgcccagggctccccagcagcctgaggcccctaaggaagaacagccctcaatggtgattctattggtgttatgagttgtgtccccaaagagatatatcagtgtcctgacccacagtacctcagaatgtgactgcatttggagatagggttcttccaggggtaaccaaggtagaatgaggtcgttagtgtgggccctaatccaatatgacggctatccttataaaaagaggaacatttaggctggatacagtggctcatgcctataatcccagcaccttgggaggctgaggcaggaggactgcttgagctcaggagttcaagaccagcctggggcaacatgtcgaaacgctgtgtctaccaaaaaaaaaaaaaaaaaatacaaaaattagctggccattgtgactcacacctgtagtgcgaggctgaggtgggagaatcgcttgaacccaggaggcagaggttgcagtgagccaagattgcactactgcactctgcctgggcaacagagggagactctgtctcaaaaaaacaaaaaaggaagatttgggctgggcgcagcggctcacattgtaatcccagccctttgggaggccaaagctggaggactgcttgagcccagattagcctgggcaacatagcaagaccccatctctaaagaaaaatgaaaattaaaaaattagcagggcatggtggtacacacctgtagtcccagctacttgggaggctgaggtaggaggatcacttgagctcaggaggtggaggctgcagtgagccgtgattgcaccactgcacttcagcctggatgatggagaaaaaccctgtctcttaaaaaaaaaaaaaaaggaaaaagaaagatttggacacggacggatacgcgcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtgatgcttttttttttttttttttggagacagggtctcactccattgcccagactggagtgcagtggcaagatcacagctcactgcagcctccacctcctgaggtcaggcaatcttcccacctagtcccctgagtagataggactacaggtgcatacgaccacgtccagctaattttttgtattttttgtagagacggggttttaccatgttgcctgaactggtcccaaactcctgggctcacatgatcctcccaccttggcctcccatagtgctgggattacaggtgtgagctactgagcccagactgtggtgctttttttttttttttttttttttgagacggagtctcactctgtcacccaggctggagtatggtggcacagtcttggctcactgcaacctccacctcccgggttcaagcaattctcctgcctcagcctcctgagtagctgggactacaggcacctgccaccacgtccagctaattttttgtatttttagtagagacggggtttcactgtgttagccaggatggtcttgatctcctgaccttgtgatccgcccgcctcggcctcccaaagtgctgggattacaggcgtgagccaccgctcccggccgactgtggtgcttttttaaggcggccctaacagactaacacagtagtgatcttcactttacagatgaaggaactgcggcttggggagataccataacggccccccggttccgagacaggtggagaggcagaaccatgggccaggacagaataggatgagtacaaggtggcatctctgggggtgcctgccccacagatccatggtcttcccatgctggtgtccccacaatgtctggcactgctccccgcttcaccttacttgcccaggcctacccccataccctcagctcacagctacacactctgcacagctcccaccccagggtctttgtgctcacagttcccctgcagatacccaaaccacactcttcccccagttcctgcaggtctttactgaagtctcgggcaggcaactcatttaaagtttcagtttagcccagcacggtggcacacacctgtaatcccagctacttaggaggctgaggtgtgagcgtcgcttgagcccaggagtttgaggctgtagtaagccatgattgcacgactgcactccagcgtgtgcgacacagcgagcccccatcttgaaagaaagaaaaaagaaattaaaaaggaggctgggcactttggctcacacctgtaatcccagcactttgagaggccaaggtgggcagatcacttgagttcgagaccagcctgaccagcatggtgaaaccccatctctactaaatatacaaaaattagctggacatggtggcggatgcctgtaatcccagctattcgggaggctaaggcaggagaattgcttgaacctgggatgcggaggttgcagtgagctgagatcgtaccactgcaccccagcctgggtaacagagctagattgtatctcaaaaaaaaaaaaaaaaaaaaaaaaaggaaggaaggaggaaggaaagaaggagggaggaagaaggaaggaaggaactctctttttctctatggcaatgagcacgtaccatctggcatgctgtgtgctaggattggttcttgcctgtctccatcagaatgggagcttcaggaaggcagggaccttccttctcttgcccactactgtactctgatgcccaggccaggcaggcatttgagccaagaatgacagtgctggtgcttcccaagcccccatctatttgggccaaccccttgatgcaaggcccttgtgctaatagagggtataggggtccaaagccagtgccttctagaagagctttggacgtgacaccaggaatggctgggcctggacaatggccttcctggcactgcccagccagtcctctgtgcttgttgccagatgcacctgatccctgagtccccagcatgggtctctttctcccaggcagatggggaactcaccttcttctcagatgccccttcccaacataagctgcttctgccctctggccccgagatggccaaggtgagctgtgtagacatagagtctggaggcatggggctggctaacgtggaggcaattctatgaacagacatggccaggccaggaatgcggcatggcctcaggtctcatccttgaaggcctgggctcctggtctgcctgcagacttcctgagaccacgtcttgttctcatctgccagcagatgcctggctcatgggtgagccgggcttaggtggaaacacaggagcccagaggggaaaggatcctcccccagcttgggctggagtcccaacttccaatcatcaatctttgcaaccctggggctggacctggctagttccatggtaaggatccttctccgtcacccagtcagtcccaggctgtgtgggaaactggctgtggtgggcaggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctggacccagaccctccagggcatggagcccattgtgaggtgtctggtgctgaagtggtgggggaggcccgtgcaggcctacagctttgtcatctgcaacattcctctccccactttctttaaactttttcatttagaaatgatttcaatggccaggcgtggtggctcatgcctgtaatcccagcactttgggaggctgaggcgggtggataacctgaggtcaggagttcgcgaccagcctgaccaaaatggagaaaccttgtctctacgaaaaatacaaaattagctgggcatggtggcacatgcatgtaatcccagcactttgggaggctgaggcaggtagataacctgaggtcaggagttcgcgaccagcctgaccaaaatggagaaaccttgtctctacaaaaaatacaaaattagctgagcatggtggcacctgcctgtaatcccagcgacttgggaggccgaggcaggagaatcacttgaacccgggaggcagaggttgcagtgagccgagatcatgccattgtcctccagcctgggtgacgagagtgagactccgtctcaaaaaaaaaaaaaaaaaaatgaaacctcgtctctacaaaatatacaaaaattagctgggcatggtggcaggtgcctgtaatcccagctacttgggaggctaaggcaggagactcgcttgaacccaggaggcagaggttgcggtgagccaagatggcaccactgcactctagcctggtgacacggcaagactccatctcaaaaaaaaaaatttttttttcaatttactaaaggatttaaaaagtagaacaaaaaattctagtgtctttcacccagttaccccaaatgtgaatgccgcacccaatcacagaaaaatgattacaaccaggaaattaacactgataatgttaaagaaagaattactgaatgacatttgctaaagcactgtagggaagactttattcaggaccgtcttgctaggtctagggaccacaggaatgagattctgcagtgggggagagagattaagctcaagtccgaatgggcaagtgggaactgatgatagctgaggagcagggcggtgggagctgggtcagcacatggaaaatgactaagaagaaacaccccgggtgagggagattctggctacaccaattaacaggatttttgctgaagacaggccacagtgaccggacatcttcacctgggggacagtgtaggaacggattagataaggagggtgatcagatgtcgagggtcaggggatgcttcttgctaaagtgactttgcagggttcttgctctaagtgaaatttacaaggaagtgcacagatgggcctagaagaaggttcagaagcctggtttggccaagcaaagaatctttgtcggtccctcctcttgttcaaggaaagaagaggttatctttccttgaatagtacgagtccatttccttgctgggctgccttttgttcattaaaggccagctgaatcatctgctgggaccggcagtagaggagatatcctccatggtgtgagccatcaggcgttgcatgttgaagataaaagaaaaagatattagttggaaccaactataaactcagtttctgagttcagagggcagctactcaagatttccaggtgctgtgcttgaagcatcttcagatggagtaggggctaacagactatcatggacggcagtttgcgtgtcatgaagtctgcccacaaattatctgttgtggtgccatcttaaagtttctttctttttttttttagacagagtcttgctgttgttgcccaggctggagtgcagtggcgcaatctcagctcactgcaacctctgcctcccaggttcaagcgattctcttgcctcagcctccagagtagctgggactacaggcacacaccaccatgcccagctaatttttgtaatttttgtagagacggagtttcaccatgttggccaggatgatctcaatctcttgacctcgtgacctgcccacgttggcctcccaaagtgttgggattacaggcgtgagccaccgtgcctggcctaaagtttctatcaagttgtccgggttcagcttaaagggcttcaggaaatgggaagttttaatttttagcggttccaggccagaagggtgggaaaaaaactggaaacatcagtttagagaaaatcaaatattggaggaaactagaagaattcaggatccaatccagtttgtaggtaaatatcaaaacctcaaaaacaatgaacagggctagaatctgataatgggtgcactatagttttcttctgaaactaatttttctctatatagtcaccccacttctatcaaagatgttgaagtaagactaatttgtttgtagctaagtttaggttgattaaacttggcctaattacttacataagtgccgcaacaatagtgattgaacacataggctttctttaagtttcctttgctaggacttttttttttttttttttttttttgtcacggagtctcgctctgtcgcccaggctggagtgcagtggcgtgatctccgctcactgcaagctccgcctcccaggttcactccattcccctgcctcagcctcccaagtagctgggactacaggcacccgtcactatgcccggctaatttttttttgtattttttttaatagagatggggtttcaccgtgttagccaggatggtcttgatctcctgacttcgtgatccgcccgcctcggcctcccaaagtgctggcattacaggcgtgagccaccgtgcccagcctgctaggacttttaataaggcatctcagattgggcttttaaaagccttgccaggctaggaagccaagccgaagcttcaccatcatacttcatttgcaatcattataggtttgggtgaattcctctctttttgaggtcccccaaaatatcctgacatccttgggcctgtcaggaagtgactttccttactcacctacaaggcaaccacatgacccatgtattcaaggtttaaaacccatttttccccaagggctttattggttccataaagtcatcttagttacttaaagttgtctggccatagctaaaaatatggcattctagtcaaagctttggtaatataaacagcatttccaattgtgtcctgttacaaagagaacaggttcttactgaacttatgtaaataaccatattgccattaaaataaaaatactcatgaatagtttccgaattatggaaggataaggtacagagaaaaagtaattgtttcacttttgtttacaaaggcatactttaccaaactgctgtaagctatggataacttaaaagagaaaaaaaagtttccttaaatctggaaaacaaaacattaaagaaccagcaatgtttcaaacaaaacataaaaaaattatcctggctgggtacagtggctcacacctgtaatgcttagggaggctgagatgggaggatcatttgaggccaagagtttgaaaccagcctggtcaacatagtgagaccctatctctacaataaaattaaataaataaataattgtaattggtttattcattgccatgtaatttattcttgttctgtttgatcttgatcagcagtttcacgaacccctcagtgtcttcattcaagttctggaaattctggccaggtgtggtggctcacgcctgtaatcccagcactttgggaggccaaggcaggcagatcagttgaggccaggaatttgagaccagcctggccaatatggtgaaaccctgtctctactaaaaatataaaaattaacagggcgtggtggtgggcgcctgtaatcccagttacttgggtggctgaggcaggagaatcgctggaacccggcaggcagaggttgcagggagccaagattgcaccactgcatgctggcctgggtgacagagtaagactatgtctcaaaaaaaaaaaaaaaaaaagagttctggaaattttttttttttttttttgagacggagtgtcagtcacccaggctggagtgcaatggcacgatcttggcttactgcaagcttcgcctcctgagttcaagtaattctcctgtctcagcctccagagtagctgggactaaaggcacacaccaccacacccagctaatttttgtgtttttagtagagatggggtttcaccatattggccaggatggtctcaatctcttgacctcgtgatccgcccgcctcggcctcccaaagtgctgggattataggtgtgagccactgcgcctggccccagccacatttcttaagtaatcaaaaacctaataaaagacaatatgaagaacaaggaactatcttgatataacacaaaaatctttgtttccaaggtcaattatttaaaaggtaaacagaggccaggcgaggtggctcacgcctgtaatgccagcactttgggaggccgaggcgggcggattacgaggtcaggagatcgagaccatcctggctaacacagtgaaatcccgtctctactaaaaaaatacaaaaaattagccgggcatggtggtgggcgcctgtagtcccagctactcgggaggctgaggcaggagaatggcgtgaacccaggaggcggagcttgcagtgagccgagatcgtgccattgcactccatcctgggcgacagagtgagactccgtctcaaaaataaaaagtaaaataataataataataataaaaggtaaacagaaatcttcataatctcaaatactgtaagaaaactttgtcatttcaacagagaagatcaagttaaagttctgcatcatagcactactaataaagctaattttaacaaaaccttataaatgaatccatccaatctcatgcaagataatatttcttttccaagatttcttttctatagatcttttacaacttaaaaaaaatatctggccgggcacggtggctcatgcctgtaatcccagcactttgggaggccgaggcgggtggatcatgaggtgaggagatcgagaccagcctggctaacacggtgaaaccctgtctctactaaaaatataaaaaattagccaggtatggtggcgggcagctgtagttccagctactcgggaggctgaggcaggagcatggcgtgaacccgggaggcagaggtttcagtgagtcgagatcttgccactgcactccagcctgggtgacacagagagatgccatctcaaaaaaaaaaaatctatcagtactttttttcccctacattttttttctttctcattctggaacaaccagttgctatatatattagcacagagtcagttattcctttaagggattttataaattaatttggtgctactatctggaggtagaaaaatatcatgtatatataacatacaaacatacatatgtagttgctctgcaactgaagttggcagaggccagacccagtggctcacgcctgtaatcccagcactttgggaggccaaggcaggcagatcacttaaggccaggagtttgagaccagtcttgccaacatggtgaaacctggtctctacaaaaatacaaaaaaatcagctgggcgtagtggcgtgcgcttatagtcccagctaccttggagactgaggcaggagaatagcttgaacccaggaggtggaggctgcagtgagccgagactgcgccactgcactccagcctgggtgacccagtgagtctctgtcttaaataaatacataaataaataaacaaacaaataaataaagttggcagagtatatagtctgaaggggtttgaggaaaggggattcaggtgactgagaagttccgatgggagaagtaggatccaatagagagaacagagaggcctcacagtgggaagaaaagactgccagcccaggagtcagggagtgaatccccattcagaatgaagagccacaaggaagaccttccaacccaggaagtattatacctttcaaaagaaggctgggaccttaaaaatcaaaatctgtccttaccagctaaaataaaagtttttctacagtcatggctcaggagtttgactcaccagtagatccccaatcagccagtcagaagacaaaggctgcaaagttgcacattgagagtcctgggtcagaggcctgtggcaccacaaccattaaagaaaaaaattattcagcccttgtcaaagcacggtcgggaaggccttattcaggagcattgccactggcatatggaccacaggcaatggggttttgctgcaggggagagattgggctgaactctgaatacagcatggacaagtgtgaactgatagccaaggagcagggcgggggtcagtggatgaaaaattactaagaagaaacataagtgataagggggatactggctaagctgacctaagaggattcttgctgaagacaggctggggtgatcagacatcacctagaggatggtggagggatgaggaatttcatcagtattgagggcgatcagatatcaaaagcagggtggttcttgctaaactggaattctcagacgggcctagaagatttaggagcctgactaaagtttggccaagcaaataatcttttgtcaatacaacaacacgatactttttactgtttgttttttttttttttttttttttttttttttttgagacagagtctcctgctgtctcccaggctggagtgcagtggcgcgatctcagctcactgcaacctttgcatcccgggttcaagcaattctcctgcctcagcctcccaagtagctgcaactacaggtgcgtgccaccatgcccggctaatgtttttgtatttttagtagagacggggtttcaccctgttagccaggatggtctcgatctcctgacctcgtgatctgcctgcctcagcctcccaaagtgctgggattacaggcgtgagccaccgcgccaggccaatacaatagtattaactaatctacagaccttgtttgaattatatcaattgtcccattaatgtcccttttctgagccaggatcccatctatcgtctggattccacactgcattttgttatctcttttaattgaagatggctcctcagtccatctttgacttgaatgatctcgatacttgaaaagcactggctggtaattttgcagaatgcccctaatttggggtttgtctgctcttcattcagattctgccttttgggcaaaaatacccacaagtgaacttgtgttcttctcaggaggtccacagtatgtcctcttactggaactaacttttttcatttctattgaggcagaatttatatacaatgcaatacacatgtttaaatggtacaatttgctaagtttgctggtgaccttgatggcttggttaaaggtggtgtcgcccaagttttcttccactctaaaactactattttccctaggcaattagtatcctgggggagaaactttgcaacactgaaaacaaaacaaaacctgtttgtcatgtttttgcccactatttttttttttttttgagatggagtctcactctgtcacccaggctggagtgcagtggcgtgatcccggctcaccacaacctctgcctcccaggttcaagtgattctcctgccttggcctcccgagtagctgggactacaggcacgtgccaccatgcccagctaattttttttgtagttttagtagagacgaggtttcaccatcttggccaggatggtcttgatctcttgacctcgtgacccacccgcctcggcctcccaaagtgctgggattacaggcgtaagccactgtgcctggcctaatttttttgtagggggttgggggccggggaccgagtctcgttctgttgcccatgctggagtgcagtggctggatcttggctcactgcaactcctgcctcccaggttcaagcaattctccagcttcagcctccgtagctgggacaacaggcacctgccaccaagccctgctatttttttttgtatttatagtagagacagggtttcaccatgttggtcaggctggtctcgaactcctaacctcaagtgatccgcccgcctcggcctcccaaagtgctgggattacacgcatgagccactgtgcctggccttgctcactattttttctggagacggtctcgttctgtcacccaggttggagtgcagtggcccgatctcagatcattgcaacctccacctcccgggttcaagcgattctcctgcctcagcctcccgagtagctgggattacaggtgcctgctaccacgcctggctactttttgtattttcagtagagataaggtttcgccacgttgcccaagctggtgtggaactcttgagctcaggtgatccgcctgcttcggcctcccaaagtactggggttacaggcgtgagccacagggcccggcccactatttttatcactcaagattttcgtctacagcagctattattggggtggctacccagtggaaaatttttctatttccactattccttccacatttattgacaggaaagctagtctaaggaagagctgtaccctcacttactcagaccctcgttttccttttttttttttttttttttgagacggagtctcactctgccgcccaggctagagtgaaagtggtgctatctcggatcactgcagcctggaactcctggactcaggtgatccttccacctcagcctcccgagtagctcggaccacaggcgcccgccaccacgcggctaattaaaaataattttgggcccggcgcggtggctcatgcctgtaatcccagcactttgggaggccgaggcgggcagatcaattgaggccaggagtttgataccagcctggccaacatggtgaaaccccgtctctaccaaaaatataaaaattagccgggcgtggtggtgggcgcctgtaatcccagttactcgggtgggtgagccaggagaatcgcttgaatccgggaggcaaaggttgcagtgagctgagatcgcgccactgcaccccagcctgggagacaaagcgagacaccgcctcaaaaaaaaaaaaaaaaagaaagaaaatttgtagatactgggctctcactatgttagccaggctggtctcgaactcctgggctcaagtaatcctcctgactcgacctcccaaaactctgggattacaggcgcaagccaccgtgcccggccgaaccaccgtgcccggccgaaccctccctgttttggaaatcctgtattagcaaaggggacagcgccagacagttgagcacacgcgttctttataaatgatgatgtctgatacagtgatgcttttaacagggttgtgtaacgcctgtgtgtgcacggtctcttctgcagtgtccaccgaaggtggcccgtctgcgtgtccgctcccggcgtactccgcgctccctgttcccggcattccccgcgctccccgagcttcccgcgctcccctgctcccggcattcccggtgcttcccgttcccggcgctcctcgcggccgccgccctcagtccagcgagccccgcctgggcagcgactgttagcgcgaccgcggcctgggcgcctggtccctcccgcgcggccgcgctattgggccgcgcgcggcggacacacgcgctacgcgccgccgattggcggcctccgcagcgcgctctgcggctcccccaatgcggggcggccgcgcgcggggattggccgcacgccgcgaaggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcggctaattttttgtatttttaatagagacggggtttcaatgtgttagccagggtggtgtcgatctcctgaccttgtggtccgcctgcctcagcctcccaaagtgctgggattacagtcgtgcaccaccgcgcccggcccagagtggttcttttaaaccataagatggtataaaacagaggcggtgtagatgcaagccagcttgcctgcttgtaaagcagctccatcacttcctggctgtatgaccttgagcatgtgggtgaacctttcttccataatgctatgtgagacctgggtgagttaaaatgcttaaagtgcttagaacagggcctggctgaggtttggttgccactgctatcctggaatcagctgatgccactgtgtgggccttcctatccggtggcccatctctctcactaagagccaaagtcctggcagcagcctgggaggaccagccctgatccatctgccctcatggacttggcccactgtcacgtcccctcagcacactgccccagctggccacaccacattcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgaccatcagctggagggtgtggagaccaagggcaaggtgggtacacagtgagatggcaggtgatagttgtgatccaggttctagtcctggaccaagtgtcacaggaagccaccagaagcaagtggtgttacctgatttttgtttaacaacatggcttctgggccacagcatggtgtgtgcacttcagctgggcagggtggaagtgccctggtcgacgtggcacttcctcaactttgagttgagggtagtggggagagcacttgagaggcgcccagagttgcactgtgaggctctgtcatcgatgtggtgcaggtgttgggggagtcggagttggtggcttggaggcacctatgagggtcctggtggagatgtggggctcggtagagggactgaagagatgcacggggactcaggctcacaggtgagaccccaggctgagggctggggtgcacaaggtggcagggtgcgactgggagcaaagcaaggggcgggtggcacatggccatcctccttgggccattgaggggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgccctagaagagcctgtgatgggggctgttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattctcgaggtatctgtcattgccgtgtgttttccagaaggcctgctgcccatcttagattctgcctaagagacttttgcagctcaacaaagggggtgtggtggaggttttgacagataacttgcagtggggccttttgtgggggtggagatgccttgggcgtggctgtgtgctcttccctctgcgggatcacccgctttcctccctatgtgctggaacccacttcccttgcccagactcttggctgccctatagacagcttggctccatgtcttgccagcactgatagctctgtggggtctatggagccatcagcccttggctatggcaactccgaccccagtgggcatatccgtgccctgccctctagcagctccctctagcgtctctcagacctggctgcatctctccacccacgccagccactgctgctgccacctggtctaggtacctgcagtagcctgctctcaggcctccctgcatggtccagggcccgcaaagctgttttctcacgtgccaccgaagtggttccctaacatacagctccgagctcctccctgcctgctcccaggaccccagggtgagagcgcacacacccagtgtggcccgtgaggctttctggtagcctgccacacgtctgggcttttccttctgtcctctcctgaccctgtcactgaagtgctgtctctcctcagggccctcgctcagcctctgagctgtggggatgggaggcagcagtgcacagttcactctgcagggtggtgagaagagggcagtgcccaagcctcaccctcgggctcttttttttcatagcccgagctacactggaaatcctcatccctgactttgttaaacagacctctgaagagaagcccaaagacagtgaagaactcgaggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttgctctgtcacccaggcagtgacagagtttgatcttgacccactgcaactttcacctcccggattcaagtgattctcccacctcagcttcctgagtagctgggattacaggtgtgtgccaccatttctggctaatttttgtatttttagtagagatggggtttcaccatgttggccaggctggtctcgaactcctgacctcgggtgatccactcgcttccgcctcctaaagtgctgggattacaggcattagccactgcgcccggccctagattgttctttatatacttgacccttgagtaacgtggaagttaggggcaccagcctctcacgtggtcgaaaattcacgcatcactttcagtcctcccaaaccttaactacttactggtaacctactcttgaccagaagccgtaccagtaacaaacaattgattaatacatattttgttatgtacatattactacatctgtccccaacctagttttggcaccagagatcagtttcagggaagacaatttttccacagacggtgttggggggcggggatggtttcaggatgactcaagcacatcacatttattgtgcactttttatttctattatcactacactgtaatatgtaatgtaatcactatacaactcaccataatataaaaccagtgggagccctgagcttgttttcttgcaactagatggttccctctgatgacgatgggagacagtgacagatcatcaggcattagatttgcataaggagtacacaacctagatcccttgaatgcactgttcacaatagggttcacactcctatgagaatctaatgctactgctgatctgacaggagacagagctcaggtgtaaaatgagtgatggggagcagctgtaaatacagattaagcttcacttgctcacttactccccctgcccccaccactcatgtcctgctatgcagcccggttcctaacaggccatggattggtaccagtccatggcctgggggttggggacccctgatatatactgtattcttacattaaagtaagttacaaaaagaatgttattaagaaaatcataaggaagagaaaatttatttactgttcttgaaatggaaacatcatcatgaaggtcttcatcctccacatcttcatgtcgaatagctgaggaggagggggaagaagaagagttggccttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaactccatacccattagcattccctcttagttctctccaaccaccaaaagccactaatctgctttctgtctctatatatctgccaactctggacatttcatattagcggaatcatacaatatgtggtcttttgtgactggcttccttcacttagtgtgctatgtcagctgtaggtttttatcagaataaggaaatttccttttgttcctggtttgctgagagtttttgtaggaatgatgttagattttgtcaaatgtttttctgcttctattcagatgatcatgtttttttttgtcttttattttagtaatatagtgtattatattggtttttgaatggtgagccaaccttgcattcctgggatatatcccacttggtcatgacatataatgatttttttaatatgttgctggattcattttgctggtattttgttaaggatttttgcatttgtagttataagcaatattgatctgtagttttcttgtgatatctttgtccagtgtaacagcaggtacaggtatcaggataatactggcctcataaaatggttggaacatgttccattttcttctgttgtgtggaatagtttgtgaaggattggtgttcattttttaaatgttttgtagactgcgttcagtgaaaccttctggtcccaggcttttctttgtccagagctacttaattgctaattcaatcttacatgttataggtctattgagattatctatttcttcttgagccagtgttgatagtttgtgtcttttttggaatttttttcccatttgatgtagattatctaattgattagcatatatttgttcctagtatccccatatgacccttttttatttctatatggttgtgatggtcccttgctgtcattcctgatttcagtaatttgaggctttcttctttttcttgatcagtaaattgttacacttgatgatacatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctcaaaaaaaaaaaaaggaaaaagaaaaaaaatatatatatatatggggtagagatggggtttcaccatattgctcaggctggtctcgaactcctaggctcaagcaatctgcccacctcagcctcccaaattgttgagatgacagacgtgccactgtgctggcattatacttcagttctttagacatggtttcttagtcctttgagtatgttttctgtaggtgatgtaaaatctgtttctggtaagtccagttctcagagagcgtgtatattaaactgcctttcccttcatgtatgggctgtctctactttcctatttctttgcatatctcagaattttttgttattgtcaagaattggacatttaaaatatatggcaactctggaaatcacattacctcacctcccttaagtttatagtttttgtcatatgtccttgctctctatttgtgactgtatcagtttgctagggatactgtaacaaagtgtcacagactgggaggcttaaatgacagagatgtatagtctcaaagttctggaagccagaagtccaaaatgaaggtgtcagaaggctaagagaaggcctttctccgtgggtggaggatagcgatctccatgtccatgcctttctctctgtgtgcatgctggtctccacattgcccatttgatagagacacctgtctcactggattaggccctaccctaatgacctcattgtaatgtgatgacctctgtaaagaccttgtctccaaatactgttgcattctgagggacttcaacatgtaaatttgggggtgacagtttacctcataatagtgactttcctagattgattctgtgaagtgtgtattctttatgatttgtggccactgaatacacgggccctttagctgagtggtctcctgatgcttggacagggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctaccactgagctggggagaagggctgggaatggggcgagttaagatgccagcaactccttgttcttagcaagactcgttgtctttcttgaatcaacactcctcagattgttgaaagcctttctttagtttccagggttctgaaagaattaattctgaccatttttgctagtgttcttgttgctttaatggaggagagcagattttggaggtccttattcggccattccagaactactttaggatgggttttgtaaagttttctcatctttgtggactggtgctgttataaaatatggttaagtgtctatggtagtactaacttgctcttaagtttcttgaactcctggcttcaagcagtcctcctgcctcagcctcccaggatgatgggattacaggcgtgagccaccacacctagtctcttgctctcaagtttctacatgttttctgtgctttatgtaactgcttcatcgtggacaggctacagacagattgcagaccacatgtggatcaagcacagtctccaagtactagctgttccaggaagagtcacatttgtccctttttttttgagatggagtctcgctctgttgccaggctggagtgcagtggttcgatctctgcttactgcaacctccgcctcctgggttcaagcgattcttctgcctcagcctcctgagtagttgggactacaggtgcacgccaccacgcccggctaatttttgtatttttagtagagatggggtttcaccgtgttggccaggatggtctctatctcttgacctcgtgatccgtccgtcttggcctcccaaagtgctgggattataggcgtgagccactgcacctggccacatttgattttatttctgagtgacccaaccgtgggaaatatggctcccagggaggcttccaaggccctctggggaagtgcttgcgtagaccctggcccaccaaaactcttagtatgggttgctgcagacgatggtgcctgagttgtgtaggtctcacgctgccttcctgtctgagtaaaagccctgcctgttctttgctatggggtggtggaaatgtccatgaaccactgtggtttctggtgccaggagagggcccagcggggagtcaggttctcagcctccactctggggttcttctgtgaagtggagaggctttgcagaaaccacattgcaaagtagtctgagaaagaagaggtttccccaggtggagaaggacatgggggtggggcatgtggtggcttccgctgtagactcccctgcctggggctttttccacacccctactccgatcctcccacactgcagcctgtctggagctagcgtcatatctccccaggtaaggagctcagtttcgtgggactgcccccacttcctgtgccagccgcaaatgggggcccctgccacccggcacaggacccctcctcgtgcttggaaatttgctaggactcaggaactcaggaaaaattttacttatgaaacttatttttcatgaagggctgaaagttcctcccctctactgacacatttgatttctccggggagcccaccctggccacctcctcagcataagctctgtggtggggtcgttttgaatcacaaaagacaaacctagcactcaggaaatcctcagggttttaagaactctgttctgggaacctgagagaagaccgtgtgtttttatgatgccatgccttggtttagggtgccttttgtatgtgcccctcctgagaagctctttgaccctcttatttgtatatatgtcatctgtgggctgggcgcggtggctcacgcctgtaatcccagcactttgggaggccgaggcgggcagattacgaggtaaggacatcgagaccatcctggctaacacggtgaaaccccgtctctactaaaaacatacaaaaaattagccgggcatggtggtgggcgcctgcagtcccagctactcgggaggctgaggcaggagaatggcgtgaacccaggaggcggagcttgcagcgagctgagattgcgccactgcactccagcctgggcgacggagcgagaatatgtctcaaaaaaaaaaaaatgtatatatgtcatctgtgatgtccccatttaaaaatctgtcagaggggaaagtagcttttccctccgttgtagggtggtgggggtgtttagacaggggtggccatctcctgttcctgggaagtttctatttgctggtcctccctagcgaggctctcaggttgtgtccccgccccctgctcctcccagctgcctgtgcagaggtgccaacacctgtccttggactgtcccctggacagcctggggcgtggggtagtatcccctccttgtgtggactccggaggtggggttgacatgtcaggaggggcgggttgatgcctgtgaggtgtggtggccacgcgtgtatgctacttgattaaaaagggaaaaaaggaacaactggcatcatttccttttcacaaagcttgtggtgatctcttggtattttgttgctagctgtgggttggtggttcatggctattaaatttaggtattagtgaccaagtgttttcttttttttttttcatcttattttaaaatttacatagagttaaattcactttttggtacagtactgtgagttttgacaaatacacagtcatgtaaccaacactgcaatcaagatgcagaacatttctgtacattccaacattcttctttgttggtcaaactctcccacctgtatcctctggtgggcactgaactgcccctgtagttttgccagatcctgaatgtcctcttagtggagtcacctggtacgtagcctttgaacctggcctctggcttggtgtggtgtgacgcatccgtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcagtggctcacgcctgtaatcccagcactttgggaggccgaggtgggtggattacctgaggttaggagttcgagacctgcctggccaacatggtgaaaccccatctctacttaaatacaaaaattaggtgggcgtggtggcgggcacatgtaatcccagctactcaggaggctgaggcaggagaatcgcttgaacccaggaggcggaaggtgaggtggcagtgagccgagattgtgccattgcactccagcctgggcaacaagagcgaaaccccatcttaaaaaaaaaaaaaaaatctgcctgcattttgattggaattgatcctgtagatcaatctggggagaatggacatcctaacaatattggattttccaaatcataaacatagttcatctgttcatttatttaggtcttctttgatatctttcatgggtggtcggcagttttcatcacacaggccctgtgtatattctactagatttatagttaaatattttatgtatggcactgtgatgaatagtaccttagttccaattgattgtttattgctagcttacagagctagaatttgttttatttgcactgatttattctagtagtttttctgtagattccttatccagttttcttctctaatttgttaatgtagttaattacgttgtttttttaaaaatgtgttcctgggataagtcctacttgggcatggtatatgttccttttcatgtgttaatggctttaatttgctagttccctgctgcatctgtgttcttggtgttaaggtcatggtacgggtagtgtcatcaagcgaagtgggaagtagccctcctcctgagtttttcagaagggcaggacagatataggattggtatcatttcttccttaaaatttgggcctggagttttcctaatgggaaagttttaaactactactgtatgaactactaactataactatgactactctgaactactgttgagtttcttgaacaggtgtagggctgttgaggctactgagatagtttgtgtcttgccaggcattggtccatctcatatagatagtggaatgtagaggtgtcgggcgtctgtggtgctcccacacggtcctttggcatctgccaggcactgattgcttaggtttctcctgtgctgtttgtcagaagcaacagggatttgtctgcaggtcacttctgccatctgtctgctctcatgagctggagcctccacctgtccctggcgggttaaccctcagtagcacatgtggcctcaggcagcttggtgcagggcatcctggtgtcggtcttttttttttttttttttgagacggagtctcgctctgtcgcccaggccggactgcggactgcagtggcgcaatcttggctcactgcaagctctgcttcccgggttcacgccattctcctgcctcagcctcccgagtagctgggactacaggcgcctgccaccgcgcccggctaatttttttttgtatttttagtagagacggggtttcaccttgttagccaggatggtctcgatctcctgacctcgtgatccacccgcctcggcctcccaaagtgctgggattacaggcgtgagccaccgcgcccggctggcgtcggtcttttgccagaaacttctgagcgtgctctctagctgtgtgtgtgtcagccactgcctcagcttctccagggccagtcccgaagccgtggggtatgtgggttcttgtgggccgacagcactggacgttgctaattggttggctggttgacaaacccttgaggttccagggcctgatgtcttggtgagtgaccttccctggaaaaagacccatgttgatttgtgcacttgagaggagcagtgtcttctggggacctatttgaagacagtagccaagccatacctcgaggatttttcgcttgccaacctcagggctagtgccttcctcttctatgcagttgcagcgagttggccttgctgcttgctggagcggcgagggcagaggagctgcccactgccctgtctgtagggccagtgtccctgtggagcgggcttggcacactgtggagcctgcacagcgaggcgtgtgaatcatttgattctaggtttcctcgctgcccatgggccaggcaggctccaggtccctgcagacccctccagaacagggccagtgggggaagcactgtgagggtgtggctgatgggtaatctccagtgcttcaaagtgtggtcttttttggaaagaggatgattgcagatagaattaggttaacatgagatcacactgaagcagagcagtggtgtgatccagtgtgtctggtgtttctctaagaagagggaggaggggcagggctagtagtccatatgaaaatcggagcaatgctgccatagccaagggatgccggggccaccaggagctggcagaggctccctagaggcttctgaaagaggatggccctgctgaggccttgatttcagacttcagaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttggcgggagggaggctctcggctgcgtggctttgagtggtagtgtcctcagctcctagactctgagggccactctctcaaggtggcagctgggtactgtgagactcaggtgcccagagcagtggcagagtgctgcctattcctgtagaatgtgccctggctggccctcggggtgtgggtcaggagggctgggagcggcagggggccccatgagcactgggtgtttgtgaccccctctccatgcttgctctttctctgtgtaggtaagaacaagagagttggaaagcagttagcctcacagaagatccttcagctgctgcacccacatgtcaagaactgggggtctttactgcgcatgtatggccgtgagagcagcaagatggtcaagcaggtaactggccatcagcaggtcccagggcagcctgtgctgccaccctggagcgtattcctgaggctctgtgctcagagggggcagagctgggcagctctgctgttgctcacagctgcctctctcctgggccacttgtgtggctttgtgggcaggggtggggtcgtcccagctacatctcctatcccagcctgctgggcatggtcagtgaagtgtgggtgattgggaacgcaggctgggcccagctatgtggcttgtagggagatggccaaagtgcaaggcagggccaggcaggagatgctgaaggtgcgcccggctcggaggtgtgcaaaggctcaggagccagggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtggaccatgaaggtcacagtcttggtgggccacctgagtcccatgtcctccctgggtgtttggaggtaggtcagtgcacctgccagggttgaatctgtagggcttggtcctgatgaagcctcctaaagccaccttgggaaccccactcaaagaggggcctgtcaggctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagttgcccatggctgcccgggggttgcatgagacgtacagcagccgcctgaggttcttagctctccggatggccaggatcaccttggaatctgaggaggcaaacaccagctgggtccccacagccagagagtgcataacatggtgagccaccccatgtgtcctcgttcccgtgccacctccttaagcaaaagccactcacgcaagccagcacggggtgggtccaggatggccacgaggtgctgggaggccagtctgctcaccagggtgggcaccaggtcctcggccctcccgcagtggaactccacattactcaactctgaagagatggcaccgtggcctgtcagagggccacatgccctcccagcagggccagccctggggaacccctagccaaagagcttgctcacttgctctacctgtcgggcagcccccaagccctggctgtggctgaggcttgcagcaggggtggcggctgcccccatccccacccccacccacggccttgccactcaccattgtcctgggcgttcacccgggcgtcctccacagcctctgggcatagctcgaccccaatgaccctctttaccttctgaaacaggaaagcgtggtgtcgccccacccagggaggggagtacatggggccctgtgggcagcaaagaggagctgggcctggggcatgatggagtcagctgtggtgactttgagctggggtcaatgggggtcttggggtggggagagggtgccctcagcagggcaggagggctcacccgggccagggccaggccaatggtgccggtgccacagcacacgtccagcaccatgctccccgcatccaattgggcccagtcctggatgactgtgtagagcacctcggctgcgggtgtgttcacctgggggcaggcggtgcccaggatgtcagtggctcctctcctgtggtgccactggtgccccgacgcccacattcctggtccctccatcctgccgggacctccggcgcccactccccaccttggtgcccaacgtcttccctgaccccaccttggaccagccttgctgatgccctcatccagcccctggctttaaaagccaagcccgtgctaagcacagcctcctccttgccccacttggttgagggctcatgaggccccgcaggccaataggctgtaccttccctgccccagcaagggggctttgcctcccacaactcacaccggggcccctggaatcacccaactgcagctcccacccccacacctagccctccaggaggtcctgccaggcctgtctccaaaaacggccgctccaggtccccacagccttcctgcagcagtgagcaaacagtgaaacagtatttcccagcccagaggccaccatggcctccctcctgccgagcccagagcagtgccctgtggtaatgcactgagggccactcctcatcctccctgtgacaagggccactgccgtgtgtacctctaggttatcccgagtcaaatcagtgatgaccaacctctttcttacttcaccctcccctgtggctcacctgcctggatactcccccaaatctcaccgcctgagcccactgttcccatcacgtcctgatggtgcgtcaggcctccctcaacatgtccccatgcccaccagggactcatggctacctggaagaaggcgtgtggagagatccggaaggtcagccctagcaggtcctcgtggatgcaccggtccccagccacatgctccaggggcaggccctcctggctaggagtctttctgtgggcgaaggtgcaggtccttcagtgtcacagtccctgcagggacctgccccgccccactcgggctccttaccgctgtccctcctccacgaagtagaggcaggtcactccactggccctgcctggccctgctgtgaagtgctgcgctagggaggtcttcagctctgccagctcctcagggctcagcttctggagtaagtggtgaaaagttcccatcaggctgtgctgaggcccacctaggctaggcaccctcccccagcagggcccccgttgagacctgggggtggaagtaggcaatggccatggcctggtggcggcggctggtgcgcacagtcagctgcttccagtggcctgtgtacgtctctgggtcgtatgccgagtatggagtggacctgtgggaatcacgagctggcccaagtgcccacaactgggcaagcagtccccctgctctctcctctggccacaccttccttcatctggctgaaatggcaggcactccagaattcccggggcaggatcaccaccctctgctcccacaccgcataggacttcccgggagccccgtcacaggtcctcaccggatgaactcctggaaggccttcaccacctgcttggtggcttcggggatgtgcacggtgtcaaacggggctgccacagcacacgtcccgcccttgtacttgccgagccgacagcccacggtgttatcctccccatccaccccgacgccaaccagaaactcacacttattacgatactcagtctgcagggagagagagctgcaccttaccctggctgcccagcgcttgggcctggaaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaacgtcatcgtcacgcgccggatccaacccccaaccactttagccagctctagaggcgcgcgtggccgggacggaagtgcgcgcgggtgtcgccgggagtgcgcgctcctctggctgacgggcgggccgggcatgcgccgcgggcgttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaaggctgactttggcccctgtggcagagtggcccctgtggagggaaaggccagtctggtgtgctgggggtgggggctcggccctgtagctcttcttttggaaagcctattgtaccctggccttggagaaaactggggtcttggcctcctggacttgaagtccacacttggcagtgttggagttatgggcatctgcagtaactttaaataaggagatattttccagtacgccattgggggttgtcatgtgtaatggattgtctctgcaaataccatcttaagtgtgtggtcccaactgccataacgtgccctgtcaccgtttgtcatgaacacctaccagacgtgcttactgtgaggctggctgcctgctgccatcacttgctctttcgtgccctccacctgggcctgggccctgttctctctgacctccgtgtgctgtgtcctgtctggtgactgcctgctggtttaaacaccagtcctttgtctctctggggcaggggtccccaatccctggcctgccgaccggtacaagtctggcctgttaagaactgggcaacacagcaggaggtgagtggtgggcgagcgagctttaccacctgagcgcctcccctcagataagcagggcattagattcctataggagtgcgaacgctaacgtgaactacgcatgtgaggaatccgtgttgtgcactccttatgagaacctagtgcctgatgatctggggtggacagtttcatcctgaaaccactcccccacccctggtccatggaaaaattgttttccaccaaactgatccttggtgccaaaagggttggggactgctgctctgggggatgtacttccaaagtcaactactctcaggtttgtttatttttacataaatgggaaccactttatggtctctagcatcagccaaggctgactttggtgggtccctgtggcagagtggcccctgcagaggaaaaggccagctcaggagagaaggctgtgccgactcctcatggtttccagtgccctacatgttcagagaaacgtctttggtaatgaactatggaaatggtccctgaaggtatggtctttgctctagaaaaagcccaactgatgactcctcactggcatcttgactgtgttctgtgagctgtggccctcatgctcatggactgcttgcctccagcaggttggcagggggacagtggtgcactttgcacccaagaagaggtgaagcctgtgccctatgccctgtgccgagtgaggtcctcgtgttgggagggtgacgccgtccactgcagatggtgccttgctgtgctgcactcttggtgacacccggggccccaggtcgggtacaggtgtcagttggaggctttgatgtctgtgaaagggagggccccttgcactggctggagcttccaggagagaagcccttggctaggacaggcaccccccagcacagaaaggatgtttagcattctgtatttgatttggggttccaataaaattccaggctgacttccttcatctggggatgggagaaatgtctccaagggagagtccccagcagtgagaaggcccctcggaatggctgggagacagtgccatcctgtggtggggctgtgttgcagggtgcatttgaggatgcagcttgttgacactgcaggatgcgatggtgctgcgggaagggagctgtgctgggagacagaatgcgtccgcgtgctggccccacgggaccacagggtaggctatacaaggacgcccatgtgggcactcgggccagccgtccagcccagtgtgtttccattggcttccctttggcagacaatggtgagcagaatggggtcctgccggtgctggggactgtgtgagaatgcagtgtgcttcagccttccatcccatgtctgtctgccgggctgcaggctggggagcctcctgctttctgcttcattttccttttccctgggatcttagctcttcttgaggaggaaactaggccatgggcttggcagccatgttgggtggggaggccggtgccaacctcgcttggttctctgtctccagtagtgggtctgcactacttgggacccctctgcccaggcctctgtgttaaggaaaagggatcccaaggccagatgcaatggttgacacctgtcaccccagcactttgggaggcaaacgtgggaggatcacttcaggccaggagttcaaggccagcttgggcaacatagtgagagaccctatctctacaaaaaaatataaaaaaaatagcctggcatggtggtgcacgtctgtggtcccagctacttgggaagctgaggcaggaggatcacttgaaccctggaggttgaggcttcagtgagccatgattgcaccactgcactccagcctgggtggcagagtgaaaccctgtgttaaaaactcaagggaaaagggatctcaccaagtaggcctgattccgcttcttcccactgtcagcatttggcagtttactccagggttcagctggtggaggaaggtgacagtcctggcaccctgcacagagcatgggcatggagtcagacctggatcctgaggggctctgtggcatgtgccactagaggaggcacttcatgggggaaggtaggagcaagggcaaggctggagatgggcaccaggtggcaggtgtgttgccaactgagaggctcacttgtggccactgcagagcccaggtaacgagccatctgctccagtggtgtctgctctaggctcaccattgtgccctgagacccctccactgcctcagagctaccatcagtgcttgggagcgctccaggctgcacctcctggagcagggcaccctgagaacagagcttaccactacggctgcctgggagaaagcccatcaccatttctgctgtgcagtagttagttgcattaagggctgggtcccggccccagtcctgggttcctccttccaatagccacaaccctggcctgcccaccctgaggagctgcggccgggtgcttccccaggggagcaggggcctgcaggccaaggagcctcatgcctgtgccgcagggtagggccgctcggggttctggttgcagaggagcagacactcagggctgggggcgatgggtgaggtccccccacagatctccacctagggaggggtctaatgggtctgggcttcagaacaggggacgctcggggcatgttggcgtggccgaggacaatgaccctcactggggacgctccggagcttgactgagggtctcccgctggcaccgcctcctctgccggcgtgtgtgtgtctgggggggggacccacacgaggccccgccccaccccgcccacagcgccgtcggccccggcccggtccaccttaagcggcggcggggcgggtgggatttcctgcgggaggagacgcgccgggcctatcgggcagggccggggcgccgggcttcccaaagggccccgcctcggggaggatgggggctccagccgaccgtctctcaagcctgcagctcgggccaggacgtggagggcccggcgcccgctggccgggctcctccagcccagtggcccgagggagggctgcgaggcggtcagaaggcaaacagccacgacgccgctgcggtgtcacacccgcgccccctcgtgaattccaaggggcttcagaccagaggggtcgttagggaaagggctgcgcccacagacgcccccgaggccacctgcacggctccgcggcccgggaccaggggggcctggccttcgccgtggtgcccaccacccgggccgcaggggtgcgtgggtgcccggcccccgagagccgcgggcgcccgccgggctggggtccccgaggccgcggggtcctgccccctccgaaggtcccgcgaaccggtggcggtccccgggccccatcaactcgccccgcccggtcccgccccgccgcggcccccagcgcccggtccaccttaaggggcgcgctgacataagagcgcagcagccgccgccgcccgtggggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgagtcggcgccgcgtctgggggcacgcgggcagcgatgggcagggcccgcacagcccgggcacgggggcagcggtcgcgggggctggcggggccccgggcagtgggcgggcggggcgccggctgcaggcgatggcagtccctctccacccgctggggctgggggagttgaagcggtgtgccggcgtcccgggcaccggggtgagtcccttgtgtggggacaccagtgcgggctgggcacctcgggagtgtccaggcaggccctggcggggagcgctgggccctggcaggggaggaggccgggctgccctgggtgtggctgcagcccttccctccccatgggacccccgaggggacgtgggccacccacaaccatgagtcttctctgcaggtggccgtgggtgcctctcgggtctcctcctggctgcccgccccgggccagagtcaagttgttcccacgtaggtgtggcctggcctcgttgccacgtgcctgccccacagccactggtgacccgggcctggcccttggcctccttctcaggaagacccagtggtcatcacagctggagggcccaggccaggccacacccagggcccgatgttagcacatcacctccgtgggctggccatggtgcacaccaggacccttgaggtcctgtttctgggagtgagagcccgcgcctgcaggacactgggcccctccagcctcaacttcttcacccaagatacaggctggcttaggaccagagaggcatgcggacagcacagcctccctctgtggctgtggggtcaccccagggctccttcaggcacaaggagggttgggggctccaggcttcggttgcacagatcttcaaccacccaccccccttccaccaatctggggttgagacatagcccaggtggcacgaacgatggccacctgttccaaggtggggccacccctgagcatgtgagcctggagaggggcaggtaggggctgcctggcgctcgtcacctttgcaagagtttggggggcccccacgtgcatcgcaaggctgaatcgggtgcccgtggaggcgagagagttacctgcaggctggggctgggtgggcaccgcaggctgccaagagcatgtttaaaaaaggcctgtgtggacgggcttatttctggctcgggcaagccagtgtgttcttgtcacttagttgctgctggtgtggggcagagagaggtgggtggggggcagcctggggagcctggcctggggggacacatcccaccaaggcttctggaggggtgggcccagcccagtgctggtccccagggcctctgtccttgggcggggggtctggcttggttccttactctgtccatgcaattcagtgtcctttctcatgactttaaaagtaatgtgtgggccgggcgcggtggctcatgcctgtaatcccagcactttgggaggccaaggtgggcagatcacctgaggtcaggagtttgagaccagcctggccaacatggcgaaaccccgtctctactaaaagtacaaaaactagccaggcgtggtggtgggcacctgtaatcccagctacacaggagactgaagcaggaaaatcacttgaacccgtaaggcggagtgagccgaaatcgcaccactgcactccagcctgggtgacagagcaagactctgtctcaaaaaaaaaaaaaaaaaaagtatgttctttatggggaacttgtgaaatacagaaaaaaaaaatgctaagaaattaaaatcaaccccacacaccccccatctcctgtcctccttggagggctcctctgttcctggcgccgcgtctgcagcctggctgtgtggtggctgcagctgctggttccctcacgcgtgatgtcagagggccctttacgtgactctgactgtgaacctgacccagccctaggcatggagtgcttgggtggctcccactctgctgagcaccagtttcccctcctctgttctggggttctggtttcggcgacaccagcagtcttgaggtatggggttccctcctggggcagtgcaggccatgcctgcacccaaccctacacctggcctatgctgacctctgccggccctgctcctgggagaagatgccatgtgtccctgtagcaggatggtggcctgggtgctcacctgggtttgatgtgcagtggccacctagcaaggctaagaagccctgcttgccccctcagggcaggtgaggccacacccctgggctgaatggctgtcagtgatcctggcctcttccccgacccgccccgcctctgctgaactcctccgagactgctcagttcctgagaaggggttctgttgggtcggctggcccattgatgccacccatagcagctgtgctgattctgggtaggcaggggtccaggcggcccccttcttggggcaggccacttgtctacccgttgccccacctcctgccctgtatctggtccaggcacacaggaaggggagcaggttgctcttgtgccccgaatccctgcccttagtgcctatacagggttcccgacttcactgtttgctcctcggacgttaccagacagtgagtggccccagccccctctctgcactcagtaaacatgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgctcccggccccttcctatgtttctgggggttttgtatccccctgggcttcagaagccctttataccatggtataatgctaggctgggtcagctgctggcagagggttcgaagacccctaggccaggctcccgaccctgccctgacttcactccagagccacattgcagaatgacagggaccctgtgaatgtccgagggctggggctgcctggcaggctgccagtgcctggggctgagccaggctggcttatctctgtctggggcatctgggatggtgtggctggtccctagatcgtcctgagccctctccttgcctggaggcccagctcaggacagcagtcagaacaggccctgggccagactagccttggtgggccaggagggactgaactgctgactgggacctcatgagtctggggaacctgggagtgaaaactcagtgtgagcccccctgctgggacccaccgcatgtggcctggggtattcctggcccccgagcctcagtttccccatctgtccaggtgtctatagggattggacaggtaggtgcaggtacttcgaggcccaaaggcctggcctgacaagggcgcagcagcttctgccccgccggtcccgagcgccccacgggcgagtgccactcatacacaaacagtgctaatgaagaacctgatttaaatgaaaacgtctgagttaaaattttccattccacatttagctgtggcggacattctgcccctaagccacccctcttgctcggcggtatctccctgccagcccaggcgggacttggggcctcagcccgggtggggcctatggtggtggtgcatgtccctgcctgtggccctggaggagggattggaacctcggggctgggccccctggacctgccctccacccgtagcttggctggagccagccaggaggggctcagagggacatggcgggccagacactccacctccagcccaggcccagagcctgtctttgcctggccctccggcaggcgagcctggtgtgcaccatcaggtctgggtgggagtggagcctccccgagcctggacccagactactgcctgctaggccctgcctgtgggaatgcgtgtctttgagtgtccctgagcatccacacatggcctcccctgtccccatgtgtcctcatgcatccttgcatgtccttgtgtgtcctcccgtgttcttgcgcaccctgagagtgcttgtgtgtcctcacacttgccctatccacagaggggcaaagggaagcccagagagtgggagggccgtgtctgaggcccagagtgaggggcagccgagccgaggctggatagggctgggtgcagtgtgaggaggcatgtgtctatgcatgcctgtgttcacgcgtgttcacacataggtcttggtgggtgagtgatgtgcaggcgtgtctgcgttcatgcatgtgcaccagtgtgtgcacgtgtgcatgtctgcatgcaagtgttcatgcatgtatatgtgttttgtatgcagacatgattgcatgtgtgcatgtgtgccttctgtgcaccagaacaggttgtctgtgtgtttatgtgtgtacatgcctgtatatttgtgtgtgtgcacacatacccatgcacatgtgccctggagcatgtttgtgtgtgtgtccatgtcttcacacgtgtctgtaggtgcctgcgtgtgctcctcatcttctctcccactgagccctgagagctctgggccctggtgggttggcctgtgagctggtccctgttaggcaggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctgtctaccaatgtggtcccctggaccggacagggccctgggttggggaggtgacaggacctgggcagggagggtggtggccaggaagggaggggagttgcatgaggggcatgaggtcagtggatcagcaggttcagcgctgaaaacctgacctctgaggtccctgggagggcctggcccagggggcaagacctgaggaccccccagtccttactgctgttgcctttcagtggagaccctcctaagacgccttggggggtcagagccccgtgcagaggggctgccttctggagggcaggtaggatgtggggtgggaagccggccctgagctggggtctccaccctgagggaccctcgctgcaggatcgcctgggcatccctcccccaatttccacagagacgtgctcaccggccacttatgtcatgattctatgtccagccacaggcccagccctcaggacagaccccacctccacccttctctgcagcttctggcaaggatggtgcacagtggtgccatgtgcagggggctggcacggccactgggcatccggggcagtgctggtcgcctggcctccttgctggggccgctgggcctctggcctagaagggcaggaagccgtccactttgaggcgcaggaaggggtccagcagggcccggagcttccagacggtggcacggctcagcaggggtggcaccagcccctcgaaaggtgtggggttcaccacgtacacgtaggcagcggtccagaccagcagggcgcccagcagcagcctcagggtcagcagcctgcgggcggcggtggtcaggggcaggggcgcgcggggggcctgggggctgggctctgccgtgcagtcacctaccagagctggcctgccaggcccttggagcttcccagctttggcctccctttctgtcggggaggggctggatcagagcccaccccgagtgtccaggctgagggcagggatccctggctttgggaaaccctcctcagacagggctccccgcaccgcagccctggccccttcctcctggacaggctcctgcagccacttttccgatgccccctgccctggacctgccctcctggagcccatttctccctctcgcccaagcagggccctgggtggggggctggtctccagacccagagtggggcgtggggggctcaccgacatgcttgccatctgcttctccttcctggctcgagtgcggcactgggcccgctccctgcgggggcctcactgtcaggaccccacaccctccacccccagcctggcacccaccccctggctcggtgctgtggaggtggggggtcaaggatgggtctgccctgtcctgaccaggacaccttctgagaccctgctcagctggcccggcccctgcccccgtgttacctgagaatctccagctggatgtcctccatctggtccagcacgccccggatgtccttcttgaggttctgggggccagaggaggtaagcacagcaggcccctcgccccgccctccgtggcctctcgcccgccgggccccgtccttctgggtgctgccctgtggggacctaccaggagcccggtggcctggttgttcagggccatgtgcatctcagccacgttgtcccacacctagggggaggtggggtcacgcctgaggagcaggacccactgggtgggcccccagcacccctccccctcagccaggcgggcacctctgtgatgaccatcttcttcctctcaaagcacaggcggatctgctgcagctcgttctgagggtggggcccaggatgggcttgggcagcatcagcagggtggccagtacctccccgctgggcccactggcctactgcacgaagacctccctccctaatgaatccctcaggcccacctggagtgctgttacgaagcttcctccccccccacagcccctcccccaggcccacctgggactgttgcacgaaagcctcttgcccctggcacagctcccgccgcagcagctgcagaggtgccctgttccccaagggctgcgtgccagccgggtcggggggctgtgggagagcccccagatcagccctaagactgcgggctagaggggcgttggctgcatggggtccctgggccctgtatttacccaggccagagcagtgcagcttgagtgttcgggacacaggggcaggaactgctgccccggccccaggagggcccccagctgctcccgaagttcctgattctgccttttctggggtggggggcagagagagggggctgcctgtcatggccgctcctgcggctggggctggggcaggggcaggggcgccaggtggtgggtggggctggggctggggcaggggcaggggcaggggcgccaggtggtgggtggggctggggctggggcaggggtaccaggcggtgggtggggctggggctggggctggggcggtgggtggggtgctcaccaggctgtggttctcctgctccagctgcaggaaggactgttctgcagagcccagcagcccgcactgaagctgggacagggctaccctgggcgaggccagggcccctccctcccgtgacaggggtgggcatgggcagggtctggtccctgagccaatggatcccccctgcctgggagccccctggttcgaccctgggtgcaggggccagccccacccaagccctgcctccaggtctccttgtctcggcccctcagtgtctctcgctctctgctcctggctggacagaaagagcccgggagcctcgccctccactgtgggcccactgccccctgcccctgggactgggaaaggtctctgggactgcactgagtgagcagaggagatggggcccaggcagggccaccctacaaatccctggcagggctggtccaggcctcctccatggctgctggaggctggggttgggggacactgggggtgggggtggccgcaggggcccagggttttcagcccctccatccctccctgcaaccccttcctgatcccaggtccaggctctggcctggcccaacctgccaccctcttactgagggggctgccccaggcaacagtcacaaaggcctgggtgcagccagggcggtcacaatgggcccctcccacctggtcctgaagctgccccgcctgatgacctcactgcctctgacccactgacccaccatgcgagttttctttctttctttcttttatgggaaggggacttgctctgtcacccaggctggagtgcagtggcacaaggtgtctcattgcagcctccaactcctgggctcaggcaatcctcccacctcagcctcccaagtagctaggactacagatgtgtgcaaccatgcccggctaatttttaagttttttgtagagataagggtctcgctatgttgcccaggctggtcacaaactcctggcctcaagcgatcctcttacctcaatatctgaaagtgttgggattacggatgtgagccactgcacccagcctagttataaaacagataatacacacactcacagtgtggattcaaaaagtatcaaacaataaaaatggtgtccaagcttttcccacctttatctcctgtccctgcagacaggagcttcctctttaagctcctagaggtgggctgccgtcccctgcccctggttcacacagaagaggtcatcctgtagcccagctttgcttttcacctaatatatctctgaggttttaaaacattcttttctagctatgtattgaatatttacattatgccagatccagtacatgccattgttatcctctgtttttttttttttttttgagacggagtcttgctctgtcgcccaggctggagtgcagtggcgcaatctcggctcactgcaagctccgcctcccaggttcacgccattctcctgcctcagcctcccgagtagctgggactacaggcgcctgtcaccgcgcccggctaatttttttgtatttttagtagagacggggtttcaccgtgttagccaggatggtctcgatctcctgacctcatgatccacccatctccacctcccaaagtgctgggattacaggcgtgagccaccgcgcctggcctgttatcctctgtttatgggtgggaaagctgaggcaggaagccctttagtcacttgccgaaggccacgctgttaacggtcggaccagatttgggtggcggaagagaactcatccgacagtagggccagattcacgccccaggcccgttccctcctgctccctggtgctcctcacaccatcggccctgctgcccctcactgcccctgagtccctgtgcccgtgtcctccttcttgaacccatcagccgtcagttaaccctcagaaagctggctcggagaagtcctcatatggtaggaagagccccgttccctcctctcccggtgtcctggcccccctgcaaggtgacttcacctcctacatcaagaggcgggtactggtctccacctctgggctctgggccggcctcggatgcacttggccaatgggctgctcctaagctgctgtgggcagaggttggcacgacacttgtgcgctgggcctggacctctcttgcttggctctggggactgtcctccctgcaggaggcctgggctgggctgcaggatgagaggccatgggtcaggagaggcttctgtcgtcccagccggtccccagctgcctaaagatgggtggacaagcccagcgaggcccccagagaaccggcccatacgttagccaagttgccggccatgtaccatcgagccccgggctgtcatggtggttttgccactgagttttggagtgtgctgtgacgtgggaggagacattgagaggcctcacaagcctagaagcgtcttaccctgacctcacacctgctggacttcgggctgggaagagaactggggccgagggcgttttcccacaggactggaaggccggtcgtggtccttggtggtgagagctggccaggctgccagccttctccccggaagcctgcagggtcccctctgatccctgcgcctctgggggtcacaccaactgtgggtctttccttcctcaccacgctgggcacttggtgagcacattctgccttgagacggggcatttctttgataacatttcttctcatttcctgcttgttctggaactcctgtcagtcaaatgttgggccttttgaattgatcctgtgagtccttctttctacctttgcttgtagatagacttccctgaacccaaacacaaacactttctctctgctttttaaaaaattggttttggggccggacgtagtggctcacgcctgtagtcgcagcactttgggaggccaaggcaggcagatcacttgaggtcaggagttctagaccagcctagccaacatggtgaaaccccgtctctactaaaagtacaaaaatttgctggacgtggtggtgtgcggatgtaatcccagctactcgggaggctgaggcaggagactggcttgaacctggaaggcggaggttgcagtgagccgagatcaagccactgccctccagcctgggtgacagagccagactctgttttaaaataaataaataaataaaaataaaaaattggttttggattttagcagtcctgtttttcatttccaagacatttccattgttccctgagctcccctcttcttgttccagagaattctgttctgctcttagggataaagtggctttggggggaggcgaatcttttgctttctgcattttctctcttgcggttcttttttgtttgtttagtcttggagcttcacatgagactcagtgctcaaatgtctggcttttctttcttttcaatccctgtttataggggagacaggcagagctgccgggcactcctctttccttgttaacttgaggaagccggacagccaggtcttggaagggaggcctcctgcctccaggcggcatctcgggctgcagggctgtggtctggagtgcggacagtaccagctcccactgctgtcctgccatgcttgttcgcagtactcgtctcctcacaccagtgacgaggccactgcttgccagccgcttgccttcttcccgccaggctgtcctgctacgtcagcctccgctctccacctcaagaagtgtctcgaaatatcttctctgcagatgacctctctcctgttctcagtgccacgtggggcctccccagcagaggcggctggacacctggccctggctgctggaggttgtttagctgccagagggtggcggtagcctccaggaccctcccctggcctctgccctgttcatcctttgccggaatgtcatgggtttcaggatgtgctgagctccgaaaccccatggggcaacttgggatgggggctaaggaaggcctcttggaggagccctgaggcgaggtggccctggggtggggtggaggaggccctgagcagcaggggagggggttgcaccctgctctctgtgtccctgagtgaatggggcaggggctgcaccctgctctctgcgtctctgagtgagtggggcgggggctgcaccctgctctgtgtgtccctgagtgagtggggcaggggctgccccctgctctctgcatctctgagtgggatgggggctgccccctgctctctgcgtccctgagtgagtggggcgggggctgccccctgctctctgtgtccctgagtggggtgggggctgccctctgctctctgtgtccttgagtgagtggggtgggagctgcaccctgctctctgtgtccctgaatgagtggggtgggggctgcacctgctctgtgtgtccccagcctgctaagtgccccacaggggccaggatgctgaggagtgagaggtcttcacagagacaggtggctcctgtaataaggaagacaacactggcttcctgggcgaacagcagggcggggtccttaggtcccactgtaggtgcccaggcccggatgagattccccagtggccctgagggggcgcccgggacaccctggatggcccagtgtcctcccgtcaccctcgcccctgggcaccatcctccttggcctggaaaccccaagctccctgacgcccccgcccctctccccgggcctgtgccggggaaggatactgctgctccgtcagtcagccatagagcccctcctcccccagcccctctcacccctccctgtggtccttgccaatcgccctgagcccgaaaaggtgggagattcttggagagatggggccctggatccccggccctggatccccatccctggggtcccccactcacggggtcagatacgctaacaaaggccaagcgccctgccaagcggtgtcctggattggggtgggcgtgggggttcgcctcaggtccaggctccgggatgtcgtgcaggacagggcgcggttgcggcgggggcactggctggaagccggaactcccggcctcgagggcggaaagtgtggccagcgcagcgtgctgggggggccatggccccgttgccaggcagcgcctccctggacgccagttgccatggaagccgcttcctgcccatgttgccagggcgtccagatggcctcgaggagcctggttcagaggggccgccctatgcccttgcccctcctccgctgcccagggatgggctgggaggacaaagaggaggagaggctgggactcccagcatggagatccgagtccttcctgctggagccaggctgcggcccagggcaggggccagatggggctgttctgctgtctgcaccgcggacttgatgttcataccccaagctcattttatttattttctatttttattaagaaagagtctcactctgttgcccaggctggagtgcagtggcgcgatcacagctcactgaagcctccagttgggctcaagggatcctcccacctcagcctcccgtgtattggggaccacaggtatgtgccaccatgcccagataattctttattgttttatttttgtagagactgggtctcgctatgttgcccaggctggtcttgaactcctggctcaagtgatctgcccgcctcagcctctcaaaatgctaggattacaggtgtgagacacctcgcctgtgcttggctgctcccgagcatatctcagaagccaggaaacaggccctgaatggatggagctcggggtcactgggccagccacagccctcagaggaccccatctctgtgccctctaacctgggctcctggcccacacccacccaggctgcctgtcaggatctgctccctctccagccctcagagctgccctatgtggagggttgggggtcccagaaaacctgggagaaacgggtcctggaaacagggtcggggggaagggcagagtgctggggatgctgggcccacgacctccctgtccctggggcttccccatgtcagaggtgaggctcagagaggtaagggcgcaccctttgtctgccccctccccagcatggccaagtcgctcccagggtgcaggcgatggcaggccatttgtctccctcctgggtgagtctctggacatggattctcacattttttatttaagaatcagagagatataagaatgtcaaggaaaaatcctctcatggacaatgcagccccagtaaatgactgtcagccggcgtgtccagggcttcaaggccccaggaagtggccatgctggggctgccaggcctctggctccagggtcactggggctgaactgtctgcccaggcccggagacaccctgcccctgaggagcccaccggcttggccagtccatcttcttggcactccctgaccaccacttaccttctagtcggacagtggagcctggggggacagcgtggcagagtgcctgatggtcggtgacaaagtcatctccaaagtccttgctggggccaagagccaggactccttgcccgtccccgtcactgccctgtgcccgcccagcacctgctggggactaggctgcccattggagaaggaaacacagtgctgggctgtgagctcctgaagcctgtctctgtgccccaggaccaggctcctgggtggagggagagaccaggggcaggtgaggaaaggcagggcccccagaatccctccatgcctgcccctcagtctccaggacttatgtgcaggtaccgtttggagctgtggtgcagttcccagtctcaccaccagatggcaccatgcccctgcagaagcagtgcccagagcaggccaggtggttctcgggggctgcggtggaggaatccacccagccgaagctctggcagggaaggggcagtgctagggggagccccctccccacttggatccgaagttcccatggggcctagggcaggggcttgccaggtagccagaagttcccttgctgagtctagggtgtctatcccacatttcacatggagacgaatcatcccagacaccccggcactgtcccggggccgtttgccacccctcccaaggggcagggctcctgtcttggggccttcccaagcatagtagccttcgggcagccccggcctggccccaggttgtcccacttgtcagtgggcagctggggctgggggaggggtcccagctcctgtccaaggtcaccattgcccctgaccagggtgtggcagctgctgtggcctgggtcagtgaggccgtggacggagggtggcctgggtgtaggcactgctctcagctaagagagagcccatctggaggaagaaccaggaaccagagggatggccgggttcccagcgtgcaggaggccagcttaagttcagtagggtccccctgcagggactccaagaggcaaaccacatggagagtcacctgagagggaatgatggaggctggggaggtggagcccccacctccaactgctgcctcggcccccacagcaggggagggcgggaggctggcactggcactgccctgggagatgccacctgggccttggtctggggaggagggctggccaggaggctgggtacggctactgctctggagtgaccgaaccatttccaccctgcttgccttattcttctcatgagggcctcaaggggacacaccagaggtttactggggacatggcaggggagggatctcagtgctggccttctggggccctgcgtccactccgcccctttctgacctgggctggggcctctgccctccccggggcctggagacagagcccttttggaggccctcaggcttgacaagcctacttcttagagccaggctgtgggctgggctgtatcctggtgggatgagggatctggggcttgggtgggagtggggctgggagcaggtggaagttggtgcctcaggctctgaggaatgggcctgggatggctgcaaagtggaggagaggctctctcaaccctgggctttggggtctgagcccagccctgtcctcaggcagtctgcccctgcagccccgcattgccatgttggttggagttgcgatgagaggtgctggggcctcccttgcctctgcccagcacagctgagaagttacgtgctgctgcccaactgtgggggtttcaaaccccgctggagcctccaggtgggcccttgggcagcagggccttgtggcgggaggaggggaccctgggaagtcagggaccaggcgggggagggagagaaggtgggagcacagttgtgggtgtgggtacccgccccttcctgaactgtgttcctcccggcccacctgactctagtcctctgtgccggctgccaggggatacccgaggccacctgcgtccccaaaagaaggtctcaccttcagagccagcctttgaggctcctgggtgacctcagcctgttacccttgaccctgagttcacctagatcaagtgggaggccgctctttgggcctcagttctcccatcctcagggagtaggtcctctgtcccctgacagcacccctcctcgctgtgccaccaccactgccagggttctgatctgtggatgttccccagggggtggctctgggctctcaggcaaccggctactgtggatggtggtttgcacgagaatagtgtcactcttgggtcctttgcttgaagttggctctgctgagtgcagcctgcagacattttcaggaaactgaatccacaggctggagccttctgcttccccacaacccaaacggcccccagccagccaaacagccacgagaacccagctgctagcaactgccagcaggaaacccactaccagccgctcacagatggacagcccatcccaggagctggccccacctccccgcccctctgctgaccaacccagcagctccttgggtgggtgtggccaccctgctgccccaacctgctcccggaccctgtgccaggaggtgcttcgcctcagcggggccttgcctcccccagagccgctctgctgcctgaccttgcaatgtcatgggtcctctgggcactggcgcagttgggtgggatcagctttggccagcaggtggggggcaggtgggtaaatcctccctctctgccatctccgcttccttcctcctgcccggcttccctgcctttttcctactctggctccagggttgcactgctcagaaagctgttgctgcctggccagcacgcaggcctgattttcctgggagcctggactaagaccctgaccagtcctcccacccaccacccacaccaccacccagctagccagcagctaggccaggagtgatcaggagggggcccaaccgaccacccacccggcgtctccagccggccaactctgcccactcagggccgtgagctggaggtgccaggagcctcccgggaggcagtgtgaggcattcttcttagtaagtcccgcatcgatgataaagggcagtatcagcccctctctgatgcgcagtgagcggctcaccatacaggggaggcgtttaatttatctcgggaactgggcgcaagttataaaaatggtaatttcttggagattcaattacatgttttcattgttaccctcgataatcaaggaaacgattttttataaaaggctgtgggatgatactgatctcaggagaggatctgggccgggtgggggctttggggacgaagaggagggcagtgtctgctgggggcaggcagggcaagtggagctgggccggccggcccaccagctcctgcagcccaccagttcctccagctcctccagccctccagttcctctagctctccagctcctccagcccaccagttcctccagccctccagctcctccggccctccagctcctccagcccaccagctcctctagcccttcagcttctctggcccaccagttcctccagccctccagctccttcagccctctctggcctcagtcttcccatctgccgacgggcccatctctggtagggagggtctgcgttttggcatgagggctgatgaagtgaggcgtgactcctgggccgtgagggtggctgcgtccctgcccctcccttcctggtgcccgagcagtctcgtccatctcctgagggctctgcagggaatagagaggggttcctggtggagtgtggacctgattttttccccaagtgatgtcttggctctaaataacatctccaggattaatgatgccggcccccaacagcaccaggtgattggaaaaagggttttatggccccgtgggtgaaattgaacttgcatctgaggtgtatttccaagatgggattttcctccctggcagaggcggcacatttcacgctaatgataatggcagctcctcgacattcatcacctatagttggggggacacccgtctggggcacaggggcagggtgtccctggggtaacctccaggtctcctaatctcagcagactctggggggctggttctaggagatgcgccctcacccagtgcagggccagggaagggggaggcaggagcccccaggggatgaacgagctctagctgggctgcaccagggaggaggctggaaggaggccccaggctgagggtaggacccggctagtgcttgcccagggacccacaggccccttgctgagcagactccagcgaggggcctggcccatcttgttgcaaagggctagagtcctgggctgagctgggcagttgaccttggatctgactctgtctcccctgaaagctgttccaccccaatgcaggctcctgcagcctagcacagcgcccagccaggatgggcaggaggaagcccttcttccgacgggctgtcaccgcgccctgcctgaggggcctcaagccccagggctcttgtctcagaactgggccgtggagattcaggaactatgggagtttgggggatcttggtggctgagggctgtgctcatggaggactccttgagttcagaagatgaggcccaccttctgcatagccaataggtcattgtcacagggacactgaccaccagcaccaacctccatcccccggcacctgcctttatcacccatttcccaggtgaggacaggggctcaaagaggggcagggttcctctgaggtaacacagcaggtgagcaacagagccagtgagggcctgggggtgtcctgccacgggctgaggtgtgcccacatgcaggaatccaggggtccgtgggccaggacactgccaagagttgggggctgggggagggaagggggcattgccaatgctgcagcccctgccctggggggtaggagggagatgcccctccgggggcccaagggcagggtgggcccatgctgttccctcccacctgccacgggtgaacctgacaggagtggggatggagcctggcatcccgagggaacctcctggagtaatcactccacatgctcgcggtaaatactgggcccttcttcccctcccagtaattgaacttatttacttttaactaagattaaatgttctctgcgagctcaagatactgactgccctgtcaggctcagtccacgctctgctcttcctgcctctggggaccaaccccaggcagggagggaccaggcagccctggagaagcacagaaattgtttttccaggaaactctgggtggataatccacttacatcatcaccactgtcaccatgagcatggccataaccaccatcatggtcagctccaccagcatcaccaccaccaccaccaccatcaccatcactgccaccaccaccgccaccatgactaccaccaccatcaccaccaccaccaccatcactaccaccaccaccatcactaccaccaccaccaccacgatcactaccaccaccaccaccatcaccatcactaccaccaccaccaccatcaccatcaccaccaccatcactaccaccaccaccaccaccaccatcaccatcactaccaccaccatcactaccaccaccaccaccaccaccaccatcactacaaccactaccaccaccaccaccatcactacgaccaccaccataaccatcactaccaccatcaccaccaccaccatcaccatcaccaccaccatcaccatcactaccaccaccaccaccaccaccatcactaccaccaccaccatcactaccaccatcaccatcactaccaccaccaccaccaccaccatcactaccaccaccaccaccaccatcatcaccaccaccaccaccaccaccaccatcactaccaccaccaccaccatcactaccactaccaccaccatcactgccaccaccaccaccaccaccatcactaccaccaccaccaccatcactgccaccaccaccaccaccaccatcactaccaccaccaccatcaccaccaccaccaccatcactaccaccaccaccaccaccatcactaccaccaccaccaccaccatcactaccaccaccaccatcaccaccaccaccaccatcactaccaccaccaccaccaccaccatcactaccaccaccaccaccaccatcactaccaccaccaccaccatcactaccaccaccaccaccaccaccatcactaccaccaccaccaccatcaccatcactaccaccatcaccaccaccaccaccatcaccaccaccaccatcaccatcactaccaccaccaccatcaccaccaccaccaccatcactaccaccaccaccaccaccaccaccatcactaccaccaccaccaccaccatcactaccaccaccaccaccatcactaccaccaccaccaccaccatcactaccaccaccaccaccatcaccatcactaccaccatcaccaccaccaccaccatcaccaccaccaccatcaccatcactaccaccaccaccaccaccatcactaccaccatcaccaccatcaccaccaccatcactacaaccaccatcactaccaccatcaccactaccaccatcactaccaccaccaccaccaccatcaccatcacttccaccaccaccaccaccaccatcactaccaccaccaccaccaccatcaccatcacttccaccaccaccaccaccaccatcactaccaccaccaccaccaccatcaccatcacttccaccaccaccaccaccaccatcactaccaccactaccaccaggaccaccatcactaccaccaccaccaccaccatcactaccaccatcaccaccaccaccaccaccatcactaccaccaccaccaccaccatcactaccaccaccaccatcaccatcaccaccaccaccaccaccaccatcactaccaccaccaccaccatcaccatcaccaccaccaccaccatcactaccaccaccaccaccaccatcactaccaccaccaccatcaccatcacttccaccaccaccactgccatcactaccaccaccaccaccatcaccatcactaccaccaccccaccactaccaccatcaccaccaccaccaccatcactaccaccaccaccaccaccatcactaccaccaccaccatcaccatcacttccaccaccaccactgccatcactaccaccaccaccaccatcaccatcactaccaccaccaccaccaccatcaccatcactaccaccaccaccaccaccaccatcactaccaccaccaccaccatcactaccaccaccaccatcactaccaccatcaccaccatcactatccccaccatcactaccactgccaccaccaccaccatcactaccaccaccaccaccatcactaccaccactaccaccaccaccaccatcaccaccaccaccaccatcactaccaccaccaccaccagcaccaccaccatcactaccaccatcaccaccacaaccaccatcaccaccaccatcatcagaaccaccaccatcaccatcactaccaccaccaccaccatcaccaccaccaccatcaccatcactatcaccaccaccatcaccatcgttaccatcaccatcaccatcaccaccaccaccaccatcaccatcactatcaccaccaccatcaccatcgttaccatcaccatcaccatcaccatcaccatcaccatcaccacacctccatcactatggtcgctgtgactgagcccatcctcactactgtcatcagcactgtcacagcaccatgctgacaagcccacagtgggtttgagggctgccattgcttgggactagttcctcaggcacaggaggctccacgctggtctgattgcattggaggggatgcctgacaaaggtctttatggggtgtgcattgtggagtggggagggggaggctcagggaggtctcgaggacttcatgccgtgggcattctccccggcccccttctgtctcagcagctccccacgcttcttgactgagctggagcagaggaagcaggcaggggtgggaggaggggcaggggcaggagaaggggcaggggcagccacaaccacctccacttaggttggagcacagcctcctggcctccctaaagtgaagggccacccagaggaggcacctaaccattctcccctccggactccacccagtgcttggatagccagcggggcagcttggggtcggggctgggcactcagccaaaggggctggagagcatgccgtgtgcagagcctgctcccatgaggtggtgagagcctgctgcactggtctcctgccccgagccttggcttgctcatctatgaacgggtgacgtggtgcctgctgcacagcaggccacaagagcagagcgacaggacacagtgaggggcggtaaggtgctgcctggtaagagagctgtgggctggcctcaaggggtagcctgtgtcctcttgctgagaatagtgggaagcgagctgcgagcttgggcccacagtggtggtcttaggctgccgtggtcacataacgccacctcccagtgcctgcggcaccacccctgggctccgcagccccagccagccgtccatgtggcccatcctgtcctctccaggcctgtctgtgtgcacccagtggagggtctcctgtctcctgtggctccctgaggctgctggtcacagagctgatgaggacactagagaccgctgcggggctgggcgggggccctgtgggagcgcagcagcctgggatctgcagctggggctgacctagcacagcaggccactgatgccacctctcaagtggcaggggcttcacagcctcccactgcaatcccggcaggcctcggtgccagggcggccccatcctgggggccactgaggacctgcatcggccacagggctcgtgagcatgggcaccccagggctcagtgggggcagctagagggagggttcagtcacctaggcctgcccagagccctgctcagggcccaggatgaactgatgggggcaacctgcaggcggtgccagcgagagtgggcgctccccacaacaggggagccacagccagcctcaccgagagcagggagggaatgtgtggagatgcaggaaacctctgccacgtccaggaaatattattaacaattaaaaattttaaatcttggtaacattcccgatggccagataattaatataagagcagataataattactcaatgattaataactgcactgaatagttttcaaagtaattgtgataaagagaatgttaaatgaaaacccatcaaagttgctgatgccctgcacagcgagggcaccttagtgctgggggtggccatgtcgactgggctgagactggccccccgggcccactgtgtcctggtggcacgtatggagtgtgaggaccacctccccaacacacacggggtgaggaccctgcacgcacatgcaaaggcaggggtctctcttagtattggggcaggtgggcagaacctgtctctcttcctgcctcactgggattgtggatgaccatggggttggctcaggagtctgccctgtgcctgcagatgttctggatatctgggctagtgttggggggtattatctgacccatggaccagtctctggttcttctattgccccagccactccaggcctttggtgaaccccctctaccattcaacttgacctgccatgttcctgagatctagcccagggctactccatccaccaattctcactaaagtgtgagtggttgcttggcactaccctaatctttgccgcctcatgtgtttattggtgtgaagccttcagctgcagggggatgaagaaggtgattccaggcagagcaggcctgctccctccacccttaggctactgactctgcagtcctggacagtggctgggagctaccaggagcccaggttggggcaggacctggggacctactgcccctcacataagccagtttctccaatcctggttccttgccctgtctgccatgcctcccagctgacaccaccgtgcggctccctcacctcatcctctgaacaggaccatcctgagttgtcacagcttccagaccccccgaagccacctggtcccctatcaggctgaggctgtccagacatggcctgccacgaggccctgagtggatatgctggcctggacaccaaggatgagggaccctggcacttcgcatctcagggatgccgggtgctcacccgcaaagacccagaggagagaaggggagaaaaagtctgaagggctcgtgaccaccctggggtcctgatggggccaggcacggtggccatacttgtaaccctagcagtttgggaggctgagatgggaggactgctgaaagcctgcctgtgcaacaggcatagaaggccctgtctgtatgaaaaataattagctgggtgtggcagcaagtgcctgtaatcccagctactcaggaggtgagcccaggaattggaggctgcagtaaaagtcatgattgtgccactgcactccagtctaggtgacagagtgagagccagtctcaaaataaaaaaataaaaaataaaaaaaaagaaggactcctggatcaccctggggccgcgcagggatgggtgggctctggaggccacaactctattctaaccacagtggtaatgatggcttcgggcaggaccactgatggcacagaaatcaccgggtgaaaggctgatgcagatgggcctgtggctgagctcagcttccccacaagatcctgcttccagaaagaagaaggcgtcctcctggtggagagccctcggagctcagcccatgaaggagggacatgtggtgcccctgctgcggctgccgctccccaagtcaccaggaaatgcagaccactgtctgcggccactgcattgcttcccttgttcagaggtcgtcatcccacagtgatggcaaagatggcagtgaccacggggcaggggagagcccagtaggcgatgggccagacaggtgcgggcccgggcagggcagatggggcgcttaaactgctcttgctgcttctttgagagttaaatgtttcaaggcacaagactttaaaaaggaggcacctggagacatgaaggccaagggtgacagcctcgtggggagggccgttgggggccttcccgatgctcggcacagatgggcactgtgggctatgggccgggcaggtgtggtcctggcctcaggttcctgtctcccacttctgggagctctgcctcccttgtggcctctgtttcaaggtcatttctggatgggcaaactgaggccccagtggctggggttgtccaaggtcctgaaggccagtgttggagcctccgggcacttggcccctgcggcccccacgccgctacccccagcccaggccctcaggtccagaacctcttgccctccagcctggggccactgttctgagagtgtgccccgaacgacactccctcattagccgagtcccagctctgtgttctggggttggagctctggggctgttgtcctctgggcctggctgctcactgaggctcctccaggggccctgccacccaccttgtgtgcctgcagatgtccttcccatgcgagcaccagtgccacagccctgaccccccgccctgcctaccccatcatggctcgccaccagcccagctgagctgctaccccgagcccaccacttccctaagccccagcttgctcctggcacctggcatcagcctgggaggggctgatgatcttgggggaggatcctgcgacaactgccgggcctgggacagtgatggaagtccaggcctccagggaggctaggaggctggtcccagtccctgctcagccattagggctgcccctccccatgttggcctcagtttccctgtgcgtagcatgggtttgcggtaaaggtgatgcactgccatggcaaggtttgttattgagggtccttggagcggggccactgcagcaggaagtccccgtggggccccctgcgtggggttggcctggctcaggagatggtcccggctgctatttcatgtatcgtgaggacaccgaatcctaccccaaggccatgagggcagaaggccaaggctgtgagccttccctacttggagacatttgccctggggagcggctgttcccagaccctacatgcctcccccacgagtgatctgcggactggggagggcactgcctacatctgccccaaaggcagtggcagaggctttgtgggatgagggtggtttgtgctctcagaggcactgggctcagccagcggctgaggtagagctggggccctccggggcaaaacatcaaaagtctctgagctcctgtccagggcttggatgagttgggattggtgctgccccagcacccaggattccccaatgcacctgccacctggcagtccctccccagggctcagcacccaccatgagtcctcaaggatttgggtgattcagtggcctgcctcgctgggcctcccccttaataatgcattcttgctaataaccttctttcctgtgtgtcattaaacacatcctcctgctggtgggtagtggagcagccggtggtggctggggaggcccgggcccccaggagagagggaaccctgggaggctggggggtaggaggggacagggctggtgcaccacctgagaataggtacaggggctccagctctgggcagcatcatgagacgcttgtggggtcgggggcggcagggcagaaaacagcctacaggggccaggctgggggctgccctcctcgtcctgtggtcactgggctatgggaatgggaatgagggcagggcagtgctagtggcccacagccctggggggcagcagcccagggatggttacaggacaaggtttgcgtaaaaccaggcttggaggccggtgtggggtgatccctcttggaggtgaaggaagggagcagtgtggcaacgtcctggaaatcatggtcagagggcccagctggggcgtgtggcctggaaaaggcactgcccccacccccaccagccagggtctttcccttgcccctgccccctcctcagggccccgccctgtcagccctgcctgtgggtttcagccccatgggcagagcatcagacttagcccgggtggaggacatggtcggtcctgcgggcaggtcgggggagtcccaggccagggcccaaggccacccgggggcagccctgcccacgcctcatctggtggaccagggagaagtcctccatcaggcatggttacaaaacttctcagacttaattaaagtcaatctccagttactcaaatgccattgatttggatctcgactgatggggaaaatatgatcatcatcatgggaaacatcgataggaaggcgctgagtacctgggcacagggccgatctggagccaacacagtcacggagcccctgctctgggcccgaccacggggccctcatgcagaacccttgtccaggcccttccggaagggtctgccacttgctgcctgggtgtccctgaattctcaccccctggctgaacccaggggcctcacagaaccgggatcctgcagggctgatgggaggctcaagggtgcgtgtcttggggccggcagcagccagcgctctgtggagaccgtctaccctcgtcacgtggctggggtcctcttgatgttgcaccggggaccctgggctggcaggactaagtctaactggggatccagggctcctgcctatcagcccccagtgagtgagtgcaagagggaaggccctttggccagtgctgcaccttttacttgcgtgggctttgaggcttggacccagcccgaggcccattgggcagcagatgtcagcacctctgtagagggcagctgaggccagacttctccatccagcctcagcagagaagcaagggcggagagcaggtagaacatcaaggcggaaggaggtgatgctgttcgggggctggggagaagtgccttcaaccagagcacctgaggttctcttctggccttgcagcctggagcctggtctggggctaggaggtgtcgcagctgtgaggccccaagtgcaggcccaggcagaggagacctggaggcagctaatgtgggggagagttgactggggatcgtaatctagttttctgtttttccttggaaaaagaaagacaaagtccccaactcacctgcccttaaaataaaaagtcacaggctgggtgcattgcctcatgcctggaatcccaacactttgggaggctgaggcaagtggattgcttgagcccaggagtcgaagaccagcctgggaaacatagagagggaaaccccctccctacaaaaaaatagaaaaattagccaggcatggtgtcgcatgcctgtagtcccagctacctgggggcctgaagtgggaggatcctttgagctctggaggtggaggcttcagcgagctgggattgcaccattgcactctagcccgggtgacagagtgagaccctgtctcaaaaaacaaaacaaaacaaaaaaaaccaccaaaaaccaaagtcacataaaatgtcttcataaatacaatagaggcaaacctcatgtgatttgtgttcatggacttggaggggccaaaggcccaacagaagtgagaggaggagggaggggaggggtgcaagggccaagggtagaggccgggaggggccagcatggtggcctgagtccactgcaggtggcactgctggctttggtgtcctcatttcatctcctgtgacctctgcccttggcatgtccccaggtacctcctgtgggctcctggctggggtggggtaggaggaggaagctgagggtggccagggtctgtgtccatcgaggggtgtccaaattctagtggagggagggctggaggggagtggggaggggcctttggccaaagccaggtgctggggtgtgacggatctccacggttgctgggaccttgtggccattcctgggacatggctttcaccttaacaagggccctgggtgttccaggggtccccatcccctgcccctgggggctcagcacacaaagcccagcctggggcctgggccatggtagccagggaggtcagggtgtgaggccttggtggcctccaggtgggcggtgagccagggggtgtggacatgtggacagtgccgggcctgggtcatgcacttcgtcaacccttcacgcctagaccacagcctctctgagcagggcccagcttgcgttgtgctgagtcttttgttactttaattaatgcccagcttcctgacgcttaattaaactggaattgctccatgtccaatagccaagcatcccattagatacaagttaatgcaactgtcgcagtggccatgaaatgaggctggtgcgtcccccagggagggatgcagaatgcatcttggaggacagcatggcctgaccgggcagctgcacacagggccaaactgagcccgtactggacagccagccctcagcccacccagtacttccacaagacccttcccaggcccctcgaggaggactccccatgggggccctggcctccagctcctctgcacgcccgagggcagcctgcttgcttcctgctgaggtttgctgttccagctccatgagaaactcatgctagtgtatcaacatttggaaaatgcagaaaaattagagaaaggaaagtagggactccccaccccagaaaggtgccatcctcccatgggcctgcgttttgggctccgtaggggctacaaggtgctctctggggcctgcagtgggggccggggcaggagctctgggaaggcgtgggggcagaggccacattgtgaggagccattggttcttcaggagccggaagttctaggatggggggcagggctgggagccagcgggggtgaggcaggctggggatgctggggtgataccttgcacccaccaatctccagtgccagcctctcaccctgatggccccgtgtccaaggcagcctcacggtgccctctgccagtggccaaaggcattgtgcctggttggtccatcaccccagagtcttttaaaattaaattaaattaaattaaattataattaattttagagatagggtctcgatctgtcacctaggctgaagagcagtggcaccatcacagttcactgcaggcttgaacgcccacgctcaagtgatcttcccacctcagcctcccaagtaactgggactgcaggtgtgcaccaccactcccggctaatatttaaacacttatttatttatttatttatttatttgtttttagatggggtcttgctctgtcacccagactggagtgcaattgtgtcatcacagctcactgcaaccttgaactcttgggctcaagtgatcctccagcatcaacctcccaagtagctgggactataggtgcaggccaccacacctggctagtttttaaagttttttgtagcgaggggctttcactatgttgcctagactggtctcgaattcctggcctcaagcgatcctcccaccttggcttctcaaagtgctgggatcacaggcctgggccaccacacccggccagcccagactcttggttcaatcccctagagggcttgagtggggcaaggaggtggcaaagtgggcagcaagggggccgccctggacaggtctccctgtccccctacccgagggtactgagcggcctctgcattgggctcccaggctgggctgggtgggtctgaggcaggagcagcctccccctggaggccagctcaggtggcagaggcccggtctgccccgggtctgcggagccgagggcaggtctctggtgcgtaggttgctgggcctggctctctctcaagcttgtttgctgtttgggtcctcctctttggggccagggccacacgcacctctgcgacattagcttggtgcctgtgaggggctgggtatctcaggagatcgcagcaggtcctagcactaccctgttgcattcttcaaggactccccgcagcccagtgtctgtggagtggggcgtgaggtgctgcctcccatgttgctgcttagaaggacgcagccctggaaaccctcactgtggagtctctgagcccctcatccgcagagcagcagttgctgctgtttgcacagacagcaaatccggggcatgtttgtttagtaagattacctctgctggggcctggcccaagggacaggccaggcacagaggggtgggggctctgtgcatactgaacacccccccgagagtggctctgtctacagccggaccactctggaagtgacggcactgcgggcctggagggctggggcagtccaattgggcaccatgccctcacaaacaacacacacaccagcggtggggttgcgagggggcgctgagggaggatcctggctgccctgcttaagccctgcagcctgtggggctgtgtccacccgggtcgcatgttgcttctacctgcacggtggccccaccacacaaggtgccgtcctgccctccagtcaacttcctggggctctgagcagcctgtggtggcacctcacctgggcagagggtgggaggagcagcgcccttccttctgtgcagggagtctgatcagggttctgtctcactgtgggacagtgggggccggggaagagcggcaggtaccaagtgcagacagcagatgtagatgcatgcgggggtccgggctggggccaagaacacagccctggagtcagggacaccggcttcatgtcctcactctgccattcaagagctgggggacctcgggcaggtggtgtaggaacagggaggagtctgcctgcagcacgcagaggagggctgtgctggtcagggggtgttttggggagaggacctcaaagggaggttgactttgggaaaggggtcagagtacagaaaaagtgggtccaaatcctgcttcagcactgagaccctgcctcggcaggggtctccaagcttggctccaccccctgaggggccagttactgcatacctcgcccacccaggagctgggggccctggtcctgtttcccagggagctgttggcacttgtgggctcctggctggggtccaggtgggctctgctcctctgccctgcccagcgctttgtactgagcccatcctgcagagactcaacggggccaaacgcacattccttgaccttctgtgagtctgtcagtcttcatccctccctggacctaggaaggcctggacagctttgaccattggtgttgggtggacatggcgctgcgctgcaccccaggccctcagagcccagctgttctgctttctgcttttggtcctgagctgccttgaaggaatctgaccagcagggagagcccacggagcgggagggcctgtggggctcagccctgcagccggtctgccgaggccaggcctgggggcacagctggggctgagtacactgaatgccccctcgatgccatgcacagcagaagagctgcccacaccgccctgctgggccctgcccgggctccagacccacagaccaagcacacaagagactgggctgctttgtcatgcagcagcaggtagccggacacatgtttccccattcccctgccatcctctgaaatcctgtggggagaaagcatgtgaggtccagtgggggttggggtgagggtctgactgggggctttctaacccacgtctgagtcccatccggcgccagtgccacagtggcgggtgactggtgctgctcacactggcaagctcctacctagactttggagcccaactccacaaggcccctgaactacccctgtaggcaccgcagcccccttgccttcctctgctacgacatcaaccactctgatggtatttgtggtttgatgtgtttaagtaaaaggcttgttgcagagtttaattgaccccatatgtctgcctgaggaggccgtgagctgcagagggcaggtgtgagctgggctctttcctcagtccccatgtcttgctgggtactcacagggcacacacgagcacgtgcggcaggggcaggggccagcgggggatggggaggcttggcgcccacggccccgctgccccatgtttccactgcagccgaggagaaaacgaggactttacggctgtcacaaacatttcatcttgtgcattttacagtccacgactgctgtgaacactggggctcctgtcggagctagaagattcataaaatgcatgtgaattattttattttattttattgttttgagatggagtctcactctgtcacccaggctggagtgcagtggcgcgatcttggctcactgtaacctccacctcctgggttcaagcaattctcctgcctcagcctcccaagtagctgggactataggcgtgcgccaccacgcctggctaatttttttgtatttttagtagagacggggtttcgccatgttagccagactggtctcaaactcctgacctcaagtgatcctcccacctcggcctcccaaaatgctgggatcacaggtgtgagccactgcgcctggccaaatgcatgtgaatttttatgttcaattattccaggttccctgctcggggcccatgggcttccccatgtacaacccaccggtaggtccccgcccagtccatgctcctcaaaggccagcctcacacccatcccacgtcctcttggctggtaaacactctcccccttcttccttctccctccacatctcaactgctggaagggaagagctcctcagtctacttggagtccctcctgcacaagaggatccagggtggtccaggagggccaaacccacctctttgggtgcacccctgggcagtggattggggatccagggcttgtgggggtatgcacccaccagggcaggtccctcaggctcactctccctgcgcctcagtttcctctcctgaaaaatgggcttgtgactaaatgttgcagggagctgctgagaaaacgcctgctgaaagcttggcaggaggtcattgtgaccagggatggggctgggtgcttcggtcaggccagggctggaggcaggggctcacactggggtcagcagtgcaggggcgtggctggcgtggcaggcgcatggggattggctcatcagttgcggcctcacgtcccttcgttatggcgcctgcagaagatgttctctgattagtctgctgaattatgaattaggttccgggtccctgtgcagctgttcccggcttgtcatccccaccactttatttccccatctgtttataaaaccaggagcgccgtcctgcaataaacacttcaaacgctttttttaggggctaattaattgtgttgcatttcttcgacacagcatgcaggccggacctgccccgaattcccaatgcgggtgtggctcctgctgagcgcctggggagggagccaggcctggagcctggggggctgcatgtggccgccccaagtttgttttctccaaggcagccctccacctttatgtggcgggctgggctgtctcaggaatgcgccggccatgtcaggttccccctagattccccctccgcaccctttggctgaagtcctcctgctcggaccataggacactcttgaaattatctgtggcacatccaaggtcaaggtcacgccctgctgccagctacagtgctgaccctgagggctccacctcccaggcccactgagcatcacgctgtcttccctgccttgcctgcccagagcacctctgccctccaggaccccctcagcgagtgcggtgggcgagtgcagtgggtgggtggcccatctaggcaagccaatctctcctcggatccgtgcacctctttggagaaggcctctgggagccccagccctgctgtgcaccctgaggcctcactccgtctgaggaacccagagagcatcgcggaggaggcttaaaacaatgacaataagaaaacaaaatcacaatcaccaagtcacgaaacagctcagaggcaattgagttaggcagccccctgccagtgcccaatgccggtaaagtggctctttaggaactgagtcctaatgtgggctgcgcagcgggtcagaggaggtgttcagcctgtggccaggcattggggccccaagccagtcctccactgcggacagaaccttgcccagctgcagctggagcctgaaggcatccactgcgtgcatctggaggggtcgggggttctttgtccccaaggccactgtggctcctgtgggccaccgtcatgtccactgggactggtgggaaactgggtctggggacttgtaccctccgcttcctcatgtcctcatcctcaggtgccctcccagcccttcaggggtcctgttttccagctgtgggcaggatgttgctcctctgccctgtctgtccacgactcagggtgccaaggctggtggagcctccctgcagccccaagggaggaggctggggccagagacgccctggggtggggcacgtctcttcccagtgaacctcagatccctcgggcgcccacgctccccactgagggcctggggccacagcactctgcctgtgaggggtgggcccttggaggcttggggacatgcgcgcccacaggcacgtggggagagcctgctgagcgctgtctcagtgatggttccccacactggcccctgacatggggcttggtgtggcagcttgttggggaggtggtgcgtggagcaggatggggaccgggaggtggttgctgtgggctctgcggggcgtgagggccggtgtttgccccaagctcagtgcctgcctgtgaccacaccagctcataagtgacctctgggtggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcggagatggagacgcgcttccctgtgtcggggcttcgctcagaacatttttatgggctgttaattgttatgctttcatttaattctgggtgtcattccatgtcagccaagcccgacaggctgggatttatgcttccaaattatggggctcgggctgttcagaggtaaaacaattacccatcaatcagccaccaaccggcttgtgctggggctggcagccccattagcgggcgtgggcagccatggcccagcaagaccccttgagggacaggactgccttcgagggcaaggcagtctgggtgaagtctcgccccaggttggccctgtgctgtggcagggcgcagctctctggggaggcggccgctcagggaaggaccccagggtccacattcacacccaactggctccagtgctgcagccctcggcctcccatatgatggtgtgaccctaggtgggctgagggtgacccgccggaagacgctgcagcatcaaggtggggggaccatgggtcccatatgctggggcctggggagccttggccagccatggtcactcagtgggaggggcagggtcacctgcctcctgagcaccccatccccaggagggagggaccaggtgtgacccacttcacagggagggaagccttggctgtcagaggggacactgcgtctctcactgggaggacctcccggcctgggcttgaggcccacctggatctgtgcaaacgtagatgtgggtagggtggggcaggggaggggaggtgggcaggggaggtggagtgggctggctgtcagctcaggagtgggggtcggggaacctgggccacagagcggatcctgtcccaccttgaccctggtatggttgagtcggcggctaagccaggccccgtggtccttcacccagggagagcctgtgccaggccaggcactgccaggccagcacacagccttgactgagcgcctccccgtctcaagttgtctcctggatgcccggctggctgctcatggggacaggggcaggatgggacagcgagaagaggtgggctcccccagccccagtgaccctccaggccagggattggcttctctccctgcagagatcgcccttccctgcccctctgcccagctgccctgggacttgtgtcccagccctgcccagcattcatcctgggtgatctgcacgtgggcatggcgcctcaccgggtcagggtggtgtccaggtgagcaggcggaggactctcctcactgcccagcagtgtcctgctcccccagctgctctgacagccaaactggtccccagctggggcatctcacgcccagacctgctgcccgttggtgcagtgcagcccccgccaatgcagacactgtacctcggtctccgggaccccctctgcccctgcaattcgacgctctgctcctgccctgctgggatcccacgtccctggaccctccctatggcagtctcgccccgcgaccctgctacaggcctgccctgccacccccgggcacactccctcatccagagtctgtgcagtcacatgtggacccctgaggccggcctgcggctccctgctcacgggcggctaaaagggggctttccagtcacgccctgccctggccttctgcctaaggccctggccctcatgggccaggcatggtcctcaggcccttggctctgccaaggctctgagaccccaccctagagagaccctggcccacccagcctggccctgcagcagtgccccaagtgcccccgagcccggcctggctgctgccagggtgaccaccaggggcagtagtcagatagagggcggtggccgggcccagtgtgtctgggtgaccgcagggcctgaaggtgtggtggcccacccgggtcagagtgaaactgaactcctaggtcagggtcgggtcctcccagggtcgtgtcctctggaacttggggcgagtcactacgcctcagtgtcatcgtgggcagaaccttccacatgtggcattgaaatctttcaaattgaataggaaaagccccacgttttctgagccctatatatagaccagtactgtcctaagtgtattctagggaaagacagtggccagccctgtagctcagttatttctgtttaaagtgtgaacgggctgggtgcagtgcttgaaaatcaagcatgaagtgaaacccagtgggccgtgcatggctctgacacccatgagtcattcacacgatgccacttgctcattgctgtcccaccccaaatgcagcactggtgggcgagaccctctgggcatattacctgcgggatgtggctccagcgcctcacttccagctcactgctgcctcaaactcctggactcaaggaatcctcctgcctcagccttctgaatagctgggactacaggcatgtgccgccacacccggtgaattttttttttgtagagaggggttctctctatgttgcccaggctggtctcaaattcctgtgctcaagcgatcctcccaccttggcctcccaaagtgctgggattacaggtgtgagccactgcacccagcctcttcaccctttaaacagaaacaacaactgaacatacagggcagaccagtgtctgtccccagtgcctgtgctgggggtgactttccagctggggctcagcattgcgagtgggaagacctcctggggccaacatggcttggattgtgagggcacgtgggtcgccgtggggccagagtccagcagtggcagagctgcacagcagtggggaggggcagggcagggcagggagagggccccggctggcccggctggcccagcctgcccagggctgcacggtttccatccctgtccccagctgcagtgggacacctgccatgggggaggctgggggaggcctggggtggcgccttgggctctcagccaggagttcgctctctccaggtcaggctggcagagcagccccagggcccctgcacccccactgcccatgcccaccttgggctctctgatgcccggcagggcctctgggcttctccctcccaagcttgggtggcaacgctggcatttggagcctggggagctgctgacagtgctggtcctgcccgcgaaggaggcggtgccaggctgtttggaaatgtcaggctgatgggtggtggcactgcccagcaccccacccccgctcccaccccaagaggctggacacgggctggggccccggtgatggagccaggccgggagccaggagatgctgctgagcagggatagctggctgagggctcctgggcggcaggggatccgaggctgatggacaaggggcctctccttgccaccgcagctgcggccttggtgggccggtcgatgcggaagagtgatggtgcacgtggggccgtggggtgtcggagggaggtttattgatgtcggctgatttccctgggggccccttgctggcagcagccaccatgctccccgagagctaaccgtatcaggccggaagggtggtgggcagtgtgatggatggactccggctgtcggctggctgggcctggatggagccccgagatgggcacactgggccgtgacaagagtgccgtggggtccctgggggagcccaaagaggcctctgagagggtctgtgctgggaggtagacctgagagaggggagacaccatcccagggtgggcacaggcatggggcagagggcacgtgacgccaacctagggccccagggggtgggacggaggggcctggttctggggcattgggagaggcctgggactctggacctggtctgtctttcttgtccccagtgtgagcaccagcccttgcagctgagccctgggaggcgcctcctgcccacgcagcaaagctcagagctctgtggcctcctctgggctcctgcacagcgggtttgctcccagctgctcccctgacacggacaccttcaagggccacgtgactgccatccccaggccttggccctcgatgaggaagggcccttctcaacctgtggctctgaaataggtctcatgatggtgccagtttaatgacaggagcagtggctaatccagtggtcattattgcatgggctgtcatgcccttctctatccgtgctccctgaagaggcgagggtccactgccggctgccacacagagaagcatggccacagaaggaggctcctctgctctgagtgggatgttggctcctcgggccacactgggctggaggacaaggggaggcaggggtgggagggccctgggctggggtggatggggtgggcctcacagatggcatggccctgtggacagcgagtggcttttcctccccaggtctcgtcctgagccctgctcctcctcctggcctcccctggccccacacctctcccactggcttcctttcctggcctctttctctctgctccttgtctccatctctcattcctctgggccttgcttcacggagtcaccagcccgtgtgacaatgtccactttccctggcctcatgtctccaacttagtgtgggacctgcctttccaggctctttggccacatgagatcatggaaacacatggctgctgtacccacgctgacctggctcagccctggctcatgatgcttcctgtgcaccctggtcccatctgtacctcagtttacccatctgccacacagggctgagggcatctgccttgtgtgtggcggtcaggctggcccagtgaccgccgagccattttggcttcctcaggtctggccactgtgaaggacatggctgtgccccccgtctgccctgtgtggccctgggcacattaaccccttccataagcctggtctgcagacgagcgcccaccgggctggcagtgcctgaagagtctcgggcgacgtccactcacctcccaatctggtcccagctctgctcaaactcagactggaggatcccccagggcagtgactccagttcagagtctagctgactgcgtccctggcagccaggcacggcccaaggtccagagctggagactgacccccctgtgtaggacctctgggaagtccccaggacccaagacggctcagggctagtgaggtagggacaggtggctatttcaagcccccagcgggcttcctgcctggggcacctgggcacagtggagaaagatggctcccggcagaacacatgcccccatccttcggggccagatgccttgggttgggcacggagcagggcccccagcagacacagaggccagggtgggaagggccagggcaccgcgcagtctcttgccctgtgtcagggctccaggcctatggtggggctgggcctacccaccctgtcactttccccatacggctttggggtcccaggggttcaggggcccctcctgcctgacccagccttaactttttgttgtttcttctcattacaaaagaagcatgttcaaaagaaccccacagtcctccatgaaccccacagtaccccgtgaactccagagtcctccatgaaccctacagactctcatgcaccccacagtcccccatgaaccacatagtcccctatgtaccccacaagctcccatgtaccctatagtccccgatgcaccccacagtcccctatgtaccccacaagcccccatgcatcccacaggcccttatgtaccccacaggcccccatgcaccccacagtcccacatgcaccccacaggctcccatgaaccccacaggcccctgtgcaccccacagtcccacatgcaccccacaggcccccatgaaccccacaggcccccgtgcaccccacagtcccctatgtaccccacaggcccccatgtaccccacagtcccctatgtacctaccccacaggcccccatgcaccgcacaggcccccatgaaccccacagtccctcacagcccccatgcggggaaagggcctcacttctggccgctgactgacttgccagtttcctggagttctttatccaactttcaaggttgctgagtcccgggaacacctcagaaacctcacgaaacagtgacaggttgtcaatcaagcagcaaggttgacatgtttgagcaacgttcagcctgggaggcgctggggccaattagcagagactcccaggtagcagagcccccgggctcatggctggggggtggatggtcagccctgacgctgctgcccccacccgaggatttctccccagccatggacttggggctgagggattcctgtaccctcccggccacctggacagggtccccgccgtggcccggcctagggcgttggctcagaccacacctgcccaaggatggagcctgacacccaggaagcagctccttgcagcgccctgggcctccgtggggcccctcttggcagagtgacctggggaccaacccccttctgtgaggcaggtgaggatgctgccttgtgggctgaaggccaaggggaagaggcatactggggccactcaggctgagcagtggtcacagcggccacccctccctctccaaggctctggcgaccactgttctgtttagcccctacccctccccaccttttaaaaagacagggtctcgctctgtcacccaggctggagtgcagtgacacaatcagagctcactgcagcctccaactcctgggctcaagcgatcctcttgcttaagcctccgagtagctgggacaacaggtgtgtgccaccatgctcagataatttttttaaaattattttttgtagagatggcggtctcactttgttcctcaggctggtctcaaactcctggcctcaggcaatcctcccttcttggcctcccaaagccctgggattatgggagccaggttcccaaacactctctgctcttccctccacctggcatctccctccccaaagctctgccccatcctgaagtccccactgcagatgctgcccctcccagaaggtagctgggcatgggctctgcagctgcagagttatggactgggcctccctgggcagcttcctgggagctgcaccatgcacgggtcacgggaccctcctgggtaggttgaactgggaggcgacagagacccttctaaagtccctatgccgggtgctgggctgtagtcacatggtgccctccccaggaatccctgaggggtgggtgcgtctctctcagcagcaccagcaaggaccagcggggaggggtgagcatctttgttctgtccaagagcctctttggagcacgagcacttgccacatgcaggagagagccatgttcactttccttttatggctgagtttgagatgtctggatagagagttatcagccaaggcactgataaggtctgcggggggaatatactgtaaagggctgagcgtggagtgggggctacctctcctgctcgggctggtgttgggggttggggtgggctgggtgaagctgccactcctggcctggatatatggagccctgggcagtcctgcctgtcccatggctttgctggacacaacaagaactgccagatgtcatttgtgtgggaatcattttgctgtttgagcgaagttggatttgttagtgtgctcaccagtgtggatggatgaggtctgaccaggaggctgcctgttgtctgtctttcacagagggccctccacacccagggtagagctggggagaaggagtcctggggaaatactgagttaaacaaggctgatgtatcctctgcaggacttctcagtgcctttagcatggcgggtgtaggtgagtctaagagatggccaggtagcctaggtgtggatatcaccaggctagggctgctgtctgtctcctctgctcacgctcctgtgcagggagggacttgagggtgggcctggggaaactgtggaaagtaggagtctctgtccccagacactgtctctgaactggggccaagattcagtcatttcatgtccccactaggcagtgcttacagatgttgcccagtatcagctgcattgattaaaggaagagctttctgaccatcaggtgggggcgctctcctggtgagtggggctgggaggcagagccctgtcctccgcggtgtgactgggacgtaatcccctcctggggctgagtggagcaggggcttgcgcctcccgcaggcctagctgtgtgggatctcatggcactctgcttttattctgtttgctccaataccttctgcttgccacctgcgatgcttattttccatttccagtggtgctgtaagacttcctttcaaaatataatcacttaagttaaaaaagcccattcgaagaaagccctcgagtaaacaatagtggagcaggtgggcaggtggagctggcccttggccggtgtgtgggctgggggcaagtgggaagggacaacgtgggaaggaaaggggagcagggggtgtggggaccctccctgggaaactcccagcccgccctggcctctgttactgcctggccctgctgagctccctgggctgctgtctggtggccaacactggcgttggctgcccacatgccatggggtctgcacacagcaggggctgggggacagcgtcacaggaggaggaaggccacctgtcacaggagaaggaagggcacacagaggcttgtctgagccccacgtgaggattaacagaggggatgcattgcagtaaagagcacgaagctgctgtgacctttgcctctgaccgccccccttgcagggccacgcctgcacgtagcctctgggcaggtgccatggggtctgccaaggctggcattggctgcccagatgctgtcctgccctgaggttccatagtcctccggccactgtggcctcacactgtgtccagctatgctttttatttacctgttaacctcccagcatacttattcatgataacagtgacagggaatggggcgaaagtctgaagtgtccttcaccagcaaggggctggtggaaaagtgggactcctgtctgaggccactctgggtggtgtctgtgtcccaggactctacagccaaacccaatgcagctgggggccttccatccacagacccacatgagcagtggtaaggacctgctatattgagccagctcctcacacacgccctcttcccagagggtaaactgaggcccaggatgttgcctcttgcctgaggctgcatggctgggtggagccaggccctgacctctttgcttcttcacctgcccagggcaggtgtttggatgttgagtcgactgatgccccagggcgccaggccctccttccatctcacggtccctgcccctgaggcccgtgtgttggggctgggtggaggtggccctgtctcctttccaggtgagtggtgcgcaccctggtgagcaaggaccccaggccctggctgcagggcctccctgtggctggaggtgtcttccacacggccagtgtccggcacgagcactctggggtcggacacttgagatgggctggaaggagggggcatagagccttgcacagacaggggcagctcaggcctgggtttgaatcctgacctaggcaccctgtggtgaggacagccacaggctgaggacactggtgtccagcatgtgcccagctgtcacctccaccctgggtttggcatggggctggcagcaggcccaggagggatgggagtcagagtgtcagggaagcagtgggaactcgggacactctgctgctccatgggaacagcattggccctgtggtgtgggcagcctcagcaactgggcaggggctgtcagagcccaggggatgctcccagaaagtgggatgggagcccagagcccacagcccctgatatcactcagcctgggagcaggcccactgcctccaccgtgcagacgaggaaactgaggagggcccttgggtcccctgcccaggcctcacagagagcaggtgacagctggagccaccccaggcttgtccacccccctgaagggatccccaggtgcccaccctcttcctgccatctgggggcatgactcctactgctgacttgagagtgaagctaccgccaccgcctccctccacacctgggccagcctgggccatgccaggggcatgcctgcttctggccccatgggcctactggtcttgaccattaaaaagcatgtgttggggctgggcgcggtggctcacacctgtaatcccagcattttgggaggccgaggcaggcagatcatttgagttcaggaatttgagaccagcctggccaataggaagaaaccccgtctttactaaaaatacaaaaattagctgggcctggtgcctcccacctgtagtccagctacttgggaggttgaggcaggagaatcgcttgaacctgggaggtggaggttgcagtgagccgagactgcgccattgcactccagcctgggcgacaaagtgagactctgtctcaaacaaacaaacaaacaaacaaacaaaaaagcacgtattgggactacagtcaatgataatttattgtgcatttaaaaataactaaaagaggctgggcacagtggctcacgcctgtaatcccagcgctttgggaggccgaggtgggcggatcatgaggtcatgagaacgagaccaacctggctaacacagtgaaaccctgtctctactaaaaaaaaaaaaaaaaaaaaaaaaaaaaaaaaaaaaaattagctaggcttggtggcaggcacctgtagtcccagctactccagaggctgaggcaggagaatggtgtgaacctgggagatagagcttgcagtgagccaagatggagccactgcactccagtctgggcgacagagcaagactccatctcaaaaaaacaacaaaaaacaaacagacagaaaactaaaagagtataattggggtgtttgtaacacaaagaaatgatgaatgcttgagataatggacaccccatttcccctgatgtgacactaaccattgtatgcctgtatcaacatatctcatgtaccccgtatctcatgtaccccatagatatacccacctactatggtcccacagaaaaggcatgtattggggccaggcccaatggctcacacctataatcccagcactggtttgggaggccgaggcaggaggatcacttgaggccaggagttcaaaaccagcctggacaacatagcgagacccccatctctaccaaaaacaaacaaaacaaaaaaacttagccaggtattgtggtctgcacctatagtcccagctacttgggaggctgaggcaggattgtttaagtccaggagtttgaggccacagtgaggtatggttacaccatgggtgacagagcaagactatttctctaaaaaacaaacaaaaaacaaaaacaaaacacaaaaaagcatgtgttttcctgttctcccaccaccccacggcaaagacagtactggctattgacacaaaaggtgtgaaacgcccacatgctaaggaagacagaagcccccagaatccaacctgggggtgtttcagaagtgctgaaagggaacagtgtggtccctttaaatgatacgaaagagaggaagggggctgggcgcggtggctcacgcctgcaatcccagcactttgggagcctgaggcgggcggatcacctgacgtcaggagttcgagaccagcctggccaacatggtgaaaccctgtctctaataaaaatatgaaaattagccgggcgtggtggtggactcctgtaatcccagctacttgggaggctgaggcaggagaattgcttgaacctgggaggcagaagttgcagtgagccgagatcaggccattgcactccagcctgggcaacagggcaagtctccatctcaaaagaggggaaggaaagtgctgggtagaggaaggcatggtccctggctagggttccacccccatggacctaggtgaggacaggcatttcctgcccacatgttgtggcatttcccaagactacccgggcctgccatgctccatcttgtgcctataaaaacccctgagaccctagtaggcagatactctagcggctggacattgagaggagtggatcagtggaagaacgcacaagtggctggacgtcaagcggaatccacagacaggcactggcaggcctggcatttgtgaagccggctgcggcagaatgatgtggagtttggctggggcagtcgtaggagagctcaggccgcccaggggaaaatcatctcccttctggctcccccatctgctgagagctacttccattcaataaaaccttgcactcattctccaagcccacgtgtggtcagatttacacaaggcaagaaccccaggatccagaaagccctctgtccttgtgataaggcaggggtctagttgagctggttaacacaagctgcctatagatggctaaactaaaagcaccctgtaacacgcccagtggggcttcacgagctgtcaacatccacccctagacactgccgtggggtcaacaccccacaacttgcccgtctgtatgctcccccagaggtttgagcagcagggcaccgaagaagtgagccacacccccattgcatgccctgcgaaggggacaaaggaacttttcctgtttcaggggaatggtcctcactgcctcctccagattttctgccctgagttgtgaggacagcacagcttgggctctgtccacagcttttactgggagcctgaggctccgtcactcactcggctgctttttcctgtgctggatgaagcccaggagctggctgtgcaggtgtgtctgggatttcatgggcatagatgactccaggacagctccttaaacaccaagctcaagcaggtattgccagctaaatgaggtcaattcctggcagtggatctcagggcgccggccttggaccccacctgcttgcccacccccagcaggcagagacctttctagaaggtcacagatgctgctgcgggatggatcgggtcccaaccctggctgggagtgatgcccgacaagctgctgtaattctcaattctgctccggaggccttggagatgctgcaggcgggcaggtggggttgggggtcagcgtcacaggaggggaaggccacccatgggggcacataggggctagtgtgagccctgcatgaggattaacagggcatgcattgcaatacagagcacgaagctgctgtgaccttcccctctgatcgctgtcacagggcctagcctgcacgtagcctcctgggcaggcacacccctggacccctccctggtgctctgctggaggccacgctgggctctggaatcttactgcacagagctcctggagacccaccctcaacccttgggccccctcttccttcctgggtcctggagggggctgttagggggcatgaggccacgcagcccttgagcacctactgtgtgcaagggcctggcgtttgtgaagcaggctgcggccatcctgggtgggagtcagggaatgggggtcccggaagtgctggcttttctggtggctgtgggggatcagggggccttgctgtgtatctgtgagctgagccatcctctgaggggctgagcgctggcaggaacctatcacgtttcccaggggcagggttgggcatgagaagccctatcctgcctctcagctaggccatgtttcataccccacagatgctttggaggtgacagatctgggtcaagactggccttcctggtgaccagccttcagatggacactgggcggcaggtgttcctgggctgccatggctggtctcctgtgctggtccccagagcagccttcctctcccctccccagacaccccatcctctgccgaggcctgtgagcacctgctgtgtgcccaccttttgcttaaaccccaggacggccttacccagatggggagccttggttggattgaaggggcttgctggaggtgcagggggaggggaggtcagagcccacatgcatcctgagctccctcatcttccacaccccatgctcatccccccaacctggccccgatgctatcagcccttagctgggggagggcggaccccggggacctcagaggcagggctcctgcaagcactttgctgcacatgtctctgttcctgaaaatgccccaaccccaccagggcagcaggcagcagggtctgtgggaaagtcaggagccccgctgatggtcctgaggggccaccccagcctcaggaggaggacctgcccttctcagggccctgctgttgctccttcagctcgcctcctccatgctggcctccgggctgctcacacgaggattagaggcaggaatgaagaaaaccaaagtcagaccactaccaggaccagggtacaagagaccaggcctggacaccacttatggctgggggccttgggctggtcagcgcctccccctcaaggcatatacacagtggatcggtaaaggctgtcccatctggggctgtgtcaggcctctgtgggaggaggcatgtggcgggcccagctcagttgatggattcagacccatgcatttggccagccctagtcagggaacattgcagccactgcctgcccagcactgggcaggaggaagtgtcctttctaagagtggagggagctcctgctctcaggcctcagaaacgaggtgctaagggggctttcaggcagcagcctcaggcaggaggagctcccgtgccatgcgaatggctttgcccagacaccgggtggctcaggcaggtcactctgccttctgtgtcctcctccttggtgggctggtgggctgagccaggagtcgggcttggggcctgttccaggcttgcaggcaggaacaggcccgggacaccccagagacaatattgatgctgtttctgcccaaacaaatgccagctactaattccggtctctgttggaaacacagaaatcaatgctcacagaacagggaggctggccctcgaggagcagtgtggtgttgggtccccaggcagtgattacgacaggacaggcaggcaggagaacagagctctcgaccttagacacgtcccatgcggccctcacctggcgacctggactcggcagcacgttgggggtcagaacagtgggttctcagggacctggcctcggggggcacccgtcatccctcagcaccctcccctgcaaaagggaagcagggcctggacatgacccccaaccctggctcctgccacattcccctgactttatttaccacccgagagactcataaataatagttgaggggtcagtgagcgaatgaactagccaaaaaaccagctggggaatgcgtgtgcaggtggagagaatgggcgctgggcctgcctgggcacaggttcacgggcctctggatgcagctcaccccgtgggagcccacagccctgcaggccgggcagcctgagggccaggacagccccacccttctctcaaggtgctggtccagggcctgtttccccatccatgtagcattcttgatctctgggtcctaccacgtcccttggatctcaggctcccagccaggaggggctcccaccaccatctcatgaccttctgaaaccccagcgctgggtgtgcaccttcttgccaggctccatgggcagcaagcacccgcccctggcctgctgggcactgcacccaggaggtgcccagtacttgctgggacagctgtcttctgctatgtcctgggctcgtgtcctgcctgcagcttccgggctggggagcttgggcaaggctcttggcctcccccacccccaccttggtatccctcaacccatccccctggacatggggttggtgcctctattggaggaggtggtaggtcaggcagcctctggcccgcaaagtcggccctgggtccaccagccgcccctctgccctgcctttcccgggtcccgccttccctttctagggctatggctgcttgtggacaagcgtctcacgggtaggaaacgggacctctgagagctcctggcctggctgggtcctcagcatgtgggtctgtgagccaggtccacgccaggcaagggtttttacctctctgagcctcggtttcctcgtctgtaaaaatcagtgaggggatgtctccttgttgcacacacagcaggactgagattagagccacagcctgccccaccccagcccctggtcaggtgggggtgctgccatctcccagcagcctgcccaggcccctccctcacctgttccgagacttcctggccccacatgggcacccggcatccttgtgggctcaccacagcctgatgctgcccacagcccatctgtgtggcctggcagggggccccacagcttggaaatgccggtatctccttgcagaccccaggtcaacactgtagattcctccctcttctgtcatggaccccaggaaggagggtgggtggggccctgggctggtgcaccgccccagaagccctcagctcctggcaggacccccctccccctgcaggccctcccctgggagcagctgcttccctgttcattccaggctgggtggggacccccaggatggccctttctctgctgtctgtgggcctagggtggggtggccctggccaggccctgtatggcctcccaggcttccccttcacccactcgttgtgggcatgtgacacattcattctaactacaaactgacacccactcactgagggcattgaaaaaccggagagccccaggagccaggtcacgtggtgaccccgacagagacaccccacaagggtgtcccagccaggtagagtggccctgggttggggaggcttttaggttggatgcttggttaggcacctgccaggtgaacctcagctgggggcagagaacctggggccaaaatctgggggccgtggtcctggggcgcttccctgggccccactgcaggcacatgccctcccaccacgcgggggagctccccctgcccgtgagccctgcttgcacttcctcacccgtcctcaccctgccccagcctccagcccgccctggagcaggctctgtccctcaggccctcttggccatggggtcagcctggtgcctgctattttgccctcaggacccctttctcctgacccctgccaggagccctcagcattcactgagttttggaggagctccctaaacacagctgtgttcactctggaaggctgagatgtgggggcaggtgcgggtggggtaatgatgttgggtgggctggcagtggagccagagaaggccctcccaggacgagggcgcagggggctggaggggagggcactcgggccctgcttgagattgaactcagttactgagcagccagtctgccaaagtctgatctcccggctttcattctacattaaaaattgatctgagatgggagaagtgaaggcagtggccatgccaccgagaaacactagctgttctctgaggctgctggagacacagcctcctccaggaaggctcccagaggcagctccagaccaccaggcccgcttcctccatgctcatctgccccacgcttgcctcagactcctggcagatcactaacccctctgagcccccagccaggcctggatgggtttgtgtttgcatgaggaggccctggtcctcacaggctccccctgtagccagggcagtccatctcatcctcacccccgtccactctgccggggctcctctgtccctgagttctgcctgaggggctgaaccaccagcctcggggcgggggaagcccactgcacaccacctccctgacatcccgggacatcttgcagagaaggaaactgaggcttaagagaggaaacagtgtctgcacagggcacaaagccacagagccgccttctgcacagctcccacctgcacctgcgtctccaggggagctgggattttccaggagtaggtcctcaactcttgggcatgtggctgggcccttcccgaccctcagaggagagcaggagccacgggacaggagtagacatgaagaagcctccacagggttgggcttgcccagggcagcctgtggccagcgctgggggtcacggccccagtggccttccgagggaatggacaggtctgccccatctctcgccttggctcaggctctgtgtgtgctcactcaatgcagccgccagctgctgctcccccacggggtctcgctcactgcatgcgggctctgctgctgctgtcggtccttggccttgagaattcctctctgggaatgcgtgtttctctctgtgaacatgttttgccttctacaggcctccttagcctcatcagagactcctgaaatgagtttcccggtcctgtgtgggccaggggccacccgcctctccagacccccagggcccatagtggcctgtccttttgtcctgcggcctcgggcccctggggtgtgtgggggggtttcctgtccttcccctgagccctggggcacggggacccctgggtggatgcccctcatcctcatccagtgcgcttgctgccggccccaggccccccgcgaggggccctatggagtcgagacaggagcccacctataggccctgtgtggcctggaaggtggggatgccaggggagctctcctgcaacacccctgacttccagactcccctgagggagggacttccacagggaaattaaccccggacgagcttggttcccaggaactcacttcgagcctccaggaaacaaacagccccagagggcaggacactcggtgtccgaggcacaggagtgagcagggtctcctgggcaccggtgacctccaccagctcatcctttgtccacacctgggtgggctgtccctggcgggctctcagggtagaggcgggggctgggtgggggcagagcaggtgcagaggctggtgaggcctgctgggtgggaggtgggggtgaccgctctctggctgccttgactccattcatcagcctgcagacccccctctccaacccccagtctttgaagccacaataaatattgatttgggcaaatcgatgcatttccgagggcctgggtcgatagcaaagttacaaggatccgggcaaagtcattcacgtgcccaactccagctctgagaagagcctggctagagctaaaaggtgactggccatgtcccgggtgccagtgccaccagctgggctaccccaagggatgggcagtgtggcccctcactctcacctggccacagccaagctggggttgaccgtcagagtccggctgcctgtctctgcgtctccccgtgtctgccccctgcccagctcctggctgcatggctgcctctccccgtcctgtctgggtgtcttcccgcctggatcccagacactcttatggggcgcttggcactgggatctgagcagttctgcacatggtaaccacgggtccagggtagagctgagggccctcatgcgacgcctccctcgggctctcacagtggcccctgcccctagatgggaactcattgcttcctaagctgcctcttccatctccacccgcagcagtgcctcaccctgaccctgggccacagaggggacatctccccaaatgcacacaccagccttggcctgcttaaggtcacctggccatctccccgctctggcctcagcctctgtgtttctgctgtcttctctgactccccgtggggtctgtggagacctgaccactgcggccccacctgggtgctgtttcgcacgtggctccctctgctctgtccaccgtccacagttcagcccttcatccaagccccccaagtgcctgaactgccctctctagagggcaaggctggggcccaggaccctgggaggaggtgcctgtcctctgagtcctcctaagccagaggctgggcagggatgcgctcaagggcggtgggcatctgggctgagccctgcaccctcttttctcctgacatcccttgcctccccccaccccgcctggtctccctccctctctaatcatttctcatggctccaacccactctgcctttcttcctctcctcgaactacaaggctgggtctggtgcactctggtggggccaccttatttatgagaatttgggaaatgcagatgtgatgtttccagctaatagccccaaatcacttgcaccgccccattagcggggaaaccagcctgtgtacattacataccacctaagtgggagccgagacagcggttttatgaccccataaaactttgggagtttattgctattgaacaaacatgtaatccgatgcttcaagttcaatatatatagccagcagcatctagagccaaccatggccgtggctcctacagctgggccaagctgctgagacatctaggggatttggagccgattggcaattgatctgctgtaggacaggggcaggatttatggtggccttgcagggctggtccttctgcatactaaacagtccagaggacagcaaggggagggcagccgcctggagcccagggcaagtggctgcttgtgggttgctggggcagagcctttagcaaaggggtatccaccttgaggacctgcccctgtaaaaacccagcttccttggagactcagctgcggtgggagccatgcagaaagtggccctgtggctgtgtgccctgcccttcaagaggcaccattgcctcctgaagcctgtttccttgtctgcaagatgtcccaggatggtttgttgcccaagaggtggcccagcagagctcctggaaggaaggggcaaacacacaggccagagcagcggtcaaatggctaagccttatccaccagagcccctcacccagctcccattcatccactgtccaccatccattcatctaaacacccatctatctaaccatccatccttctacccattgatcctttcacccatccacctgccactgatttatccatccatccctccacccatatacctatccatccatccatccatccatccatcctttcattcatccatccacctgcccatccacctgctcacccatccattcatgtgtccatccatctatccatccatttactcacctgtccatctctctattcatccactcactcatccatgcatctatccacccatctgctagtccatctgctcatccgtccatccactcatctatccattcatccatccctcccaccattcattcctctatttgtccacctgtccacctaccattcatccacatagccatctctctatgcacccatctgttcatcccccatctactcacccatccattttcacctactcactgtccatccacccacctgtccattcacccacctatctgcccatatacttgtgtgtctgttcactcattcattcaccctccattcatctgcccatatacttgtatgtctgttcactcattcattcaccctccatccatctgcccatctggccttctatcctttccctcaaagctgccccttgtccagggacagggctgtccttatagtcgcagagatgattggagcctgagagagccaaggtgacttatctcaccttgcagaaggtgctggcattattgcttgctcaggacacccgcatcctcttgccctgggcttcacactccaggaatgcctttctcatgtctgtgctgcatatacttattgtaagtaaaggagaacctcatggccgatgatagtttgttcatttcctcccagtcttattgtgtgcacctattctttcttccaagttcacagtctctctgggcttgtatggcgtgcatttcactcaccacagatgtctcttcggggctggtccatggtgttactctcccagcattgacttaaacatttccccactgttggatagtgtagctgtttccacctctttgtggttataaatatgctgtggtcattatctgagctggcagagtgaagtccgcccctctacgtgtttaattagcatagactccaagagggggcattcatgggttaagcatctcatgacttgggacaccccttgtccgatgacaaaaacctggccctgtgatccctgccctcagtggaggagggagggccttccgtggtgcccggccggaggggctgggatgtgttcactgtgagtctggtgggtctcacatgtaggcagagtggggacaaggcagcctgctctgtggcgtgtcccatggcgtccgggttgccttgtctgcagttcactcacattgcccttggtgttgctgcttcagataagttcctgccgtgttaatgctattaattttttgtcatgttagtgtcaaaaatttacccgcctcatttcttgtcttttagcttgatgttttcctttgagccacctgagaatttagcttccacacagtcaaagtgaactcatccttccctttattcttggaaagttccttctcaccagggattcggtaaatatttgcttctgtttacttcctgttcctttcaatggtttaagttattttctgtcagcatcaacttattccccagcccatatccgcaggcctcacactctaattaagaggatgccctatggccgggcgcggtggctcacgcctgtaatcccagcactttaggagcccgaggcaggctgatcacttgaggtcaggagttggagaccagcctggccaacatggtgaaaccccgtctctactaaaaatacaaaaattagccgggcatggtggtgtgtgcctgtgatcccagctactcaggaggctgaggtaggagaattgcttgaacctgggaggtggagattgcagggagccgagatcatgccatcgcactccagcctgggcaacagagtgagactctgtctcaaaaaaaaaaaaaaagtaaaaaataagaggacaccctgtgtccctccctctctccctccctacccttccttccttccttccttccttccttccttccttccttccctcttccctccctccctccctcccttccttcctccctttctgcctaaacttttctcaatagcctcaaggctgcaaataagacctgcccctggcctcagtgacttggtggcacagacgtgcaaagcacagaacgcagaaattcaagtcagggctgaggactgggggtggatgggggcctgctggggggctgggggagagagtggcagggtgagctggggacattggaaaactcttgcagctgtgactgatgatggtgggcaggtgtaaggggtggcttttcgggggaggcacattttggcactgggttatgtgcttcagcaccaggagcaggggtgaggtagcagacggaggggaggaggccatacacctgggcaggggctggatgggactggctgacagctgacctccctcctgtgcccagagagccacagcctgctcggtggcccgcatgggatgaaacctttgtggtcccagcttctgatcactggaggtgagaactagtttttgagagacgggagcaactgctgaagacccaggggctggggcacggcccagcgtttgcttttgagagcttcgccatggcccgtgtggagaggacagcaaccaccagggagggggctgggtgccccagcctgtctgccagcttctgagccccacctgcgtctgcacctactggagacagctgggtgggctctaacctggatggtcctgggtgggaatcccagctctgcctcatgtgagatgagggctgagcctctgctcatcttagaacctcagttttgtcacccatacaatgggatggtcagttagcaaggaaacgcgtgtaggtgccccgtgtagtgccggctgcctgggaggcgctcccagaatgtttcagaggtgattcttctcaaggacttcctgggccccttggtcataaggctctgaattcccagcctctggcctgagtgccacagaccctagagggttcctggccactcctggggtctgtgtggacctcgctgcttaaggccccccgtgtgcactgaagcgcgacaccccgcacgcaggggccatcaggtctttggggattgatagaattaagcccatggaacgtgcatttgcttgctgtgaagccgcaacaatctcgctgccacagggcagaggacgttctgaactgagtgtcccctcggctccctcaccggcctcctgcaccagcagatggtgcctgatgtggtggctggcactggtgccccttgccctctgagcagcggtaccatcaaaacccatcttcccagcagctcaggatcaccgcggtggagtttccagtcgcagatgcccttggcaggggctgtgggactgcaggggagacggaggtctgggccctaccatgtgggggcagcatgcaggaggggcccattcctgccccccggcaatacaagaagcctacgggggtgcccaggggtcagggacctgagagatgtgctcactgagacctagcatgctcacccccagctgccagagggggtagttcccaaagaggggcaggccctcagagtgagctcctgtcctgagatgggcaagggaatattcctgggacactgcagaactgttaccaagccaggcacagatggggccaggcccctcggcctctaagacaaggccggcccatggatggagcacgatggccctgaccttgggcacagacccgacgattgagtgagatggagacacaggcttggcttgtccccaagaagaaagaggcacagaagcagctacagagtttcttgcttccctgtttgggttgctgctggctcaggtaccacagctggcaacagaaacagaggtcaaggcccagagggagggaggggtcgggtctgctttgtccagggctggctggccccaggagggccccgaagctgtggcagaagcaggtaccagatggtcagtgtagcactgtggctagcacccaaaactggacatgggctgggagcagcctgagatgcagggcagaggacagcaagccacgagtctgaatggcccctgttctggaggcagtgctgggaggtggaggctggagggggtgtctcgcagagcctggtctgctgagacataggctgggacaggctgctgggtgtactgtccctgggaagtgcaaggtggcgagtcaggaaggccccaggagcagggttggggcaggagccagtgagcagggcaggaccctcatctggaggggctgggggaggtctccagtctgggatgggggtgttcccggcaccagcccagtgtttctggtgcagcagccacgtcattatggttggaatgtgaccccattagccctggggcggggctgttcaacatcctgaggataattgatcagagggaggaggggctgcaccgcttcctagcaggttgagttaattatcagcctgcattagcacttgacctgtggcatgtgtcaactcattactgctaattgcagggactcagtgacctctccgaacttctgtcacccctgtcacggcccctgccctgtggaggcctgtggaatgggaagtggggaggggaaggagaagggggcggagtcagccggagcctcctggccaggcctggagtcaccctgtcctgccacagctctcatgggtttagagtgggccctggggcagagggtttgcaaggataggggtgggtggctctgccgagggcggtgttctgagtaggtctcattccccagtctgcccagcctggccccaccccagctctgctgccctgttactttgtccccctgtgttcaccctccacttcctgccggggacactccaaggcctgccaaggttggagcaggggtgggactcagccattcaacaaacgcttccttggttatgcagggctgggcattggggtggggggctgacctggaccctccaagacatcagattgtccaactgctcagttttcattggggcaagtgcctcgctgagggtgaagggggctgtgagtgcccatcagggagcctggacaggtcccgcctctcacagctgtcccactctctggagctgccttggtggcagatggcactgtcctagaaaggtgaggctggagctgtctcttccaccaggggtggccaaggacgcttccagggtcttccatgcaggcctccagggtcaccctgggcgtggctgagggcatgcagaccacgctgtgctcccccccaccccccatgcccgtcgcttgcctgacatgctcctcagctgtcttgccccgcagaagctgtgtggtctcccctgtgagtagagtcgggctccatgatcctccggagcagcgccagggactctccccaggcacaattttaaagggggccctaggacctgccaggtccacggaagtggtccttgtaactctctccctggtggcagcctctggtgcattccggcaggggcagcccctcctcatcacagggaccctgtgtgccaggccccagctgcgttgccgctgaattatggatttaatagcagagaagccttgcaggccgcctgtgctggctcgggaaaccggggcccagccggggcctgtcacggtcctggtgccgccctgcttcctgtcggcgccacggagcaagcggagagatttatcttcccggctttaagaggtactaacggaggaggctgagaggcaggagctgaataattgatggccttctctggctcaggatctgctgaaaatgacacggtgcaaggcagaggggctgagagtgctgaccacaaaatgctgagaagccactccagggcggtcacggccagaaggaggacccccactcaggacggggtcacaggcatttggggcgggtgtcagaggctcctgccctgggtcattccagggggccaggatacccagaagctgggcctagaggcccacagggctggctcacccccacttccctctcacacgcctgccatcaccggtgcttcagcccagcaaccccatggctcgttggccccgtccacagcccccactgcctcctgtgtgctgggcgtgggcctctgagctctactctcagcctccttagccccaggagaggagtggaggacaggggtttaacgtggggtgtggtgcggagcggggagggctgtggcgccccctcagcccctcctttcctaacagcctcagcctcccccctggagaatcccctacctgctgggcacatctggcctctccccaccattctgtctccagccgggagatctctacccagtgaaacagtgaaacaggaagggttccctggttaccccgcgcagggcgcagggcatgcagcgggggagtggctcgcttcttcagtgccccaccgctcacacctctaggggagcatacagacgggcaggctgtggggctctgaccccatggcagtgtctgggggtgaatgtttacagctcttgaaaccccagtgggagtgcgttaccgggtggtcttttagtctagcggtctgtaggtggctggtgagagtgagctcaattagacccctgccttataacaaggacagaggaatttctgtatcccagggtttcttgccttggtgtaccaaaaaattggatcacacgtgggcttggagaatgagtgcaaggttttattgagtggaagtagctctcagcagatgggggagccagaggggagatggttttcccctggagtcaggcaacattctcgggatgtccagcagcttgtcttcttccaccagtgtgttcctctccccacacagaggcttctgtctctgccttgctagggtcttgggtttttataggcataggatggaggcatggcaggccagggtggtcttgggaaatgcaacatttgggcaggaaatgcctgtcctcacctaggttcgtgggggtggagccctaggcagggaccacgcccttctctacggagcacttcccgtccctcctctgtatcatttaaagggaccacgcttttcccttctcagcacttcctttccgtatcaacaggaggccagggactggctggacccctaggagccaggtcctacggataggtgagccggccccccagggcaaacacctccactgggcagacctgactgcccagagctggattctttacttgtaaaaggggccatgagtgacacaggctcggcctgctgtgccttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggtgacctcgtgtcggcaccacgcccttctcccatgggcagtcctgggcgccccttcctggccttgggcccagtggcctgtggcctgaccccgtccactcctgcttggttgtcccagcagcagcaggagcccatgctggagaaggtgttatggggcaggtggagggcccggctgactcagatgatcccccaagtttcttttcaatgaacacttgtttagtgcagtttttcctcctcaaatccccctcacacaggcagacaccctcttggcccagggtaatctgctgagcctttgctcaaatatagcagctttgctgctttctaaacacaactaatccaatttgggatttggggattcgaggtgggcagcactgggcctcagatgagcccccatcaccccagacccatgcaggaagagccaggcagggtggggccctggggccacctggtgggctcagggccagggcatcgcgatgtccccatccttcacactacggggcttcctggctgcagagttggggactcagctgggaatgctggccatagaggcagagagcccccatcctgctgggccagccctgacctggcttctccagggtggcccagtgtccccttctgcccttcccctggctcccaccgtccacatccctctatctgcccaccctggacaacaaccagcacagtgcagtgtggccctgcagtgacaccacctgcagagaggtcaggcccagcctcccccgtctcctaaaaggccagcaggtcccaggagctgggggtggggcctggctgtggggcctccatgccccaggggccagggcagaccctccttagccggcaaccactgcagattcctcccctggccagcactcggggacctccctgcccctgccccgtccccctaccttgcctgctgagacatagggctccacgggtctctctcctggggccgggctgactgtggcctgcgaggggcagtcatcgtgttgggttttcctgccagaggcagaaaccacaaaattacctggaacatacacgccccaagtgacagattcaattcaattccacaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagcacggggacatttatcagaaatggaactgatggattaaagtggaaccaagcgaattgatttttctccctgggcactgaaatgctgcgcttaatcaagcgatcaactccgtgggcagggtggctgtggggacggaggtgggggacaaggggatggtggccatggtggggactgaaaggtggctatggggacagatgaggtgagccaggtggccctggggtcgagctccagcccagcctctggcaaagaggccctgtgtgcagaagtccgggtgtgatgccctccccccaccgattgtgtgataccggccagtcctgtcccggctgagcctcggtggccttgatgtaaccctgtggggtctggtggcagggactgattcactcatttgctcattcattcatgtgtttgacacacactgcagcaaaggaaaggtgagagcagccacaggctggccagggacgattcagacttcagagtgtagcgtgcccgcccctcctcttgtgaggtccagccttggtgtgtgtggattcccaggcaccctccaggtccaccctccactctgcagtgccccgcccacctgtccacatactctgttctgtggtttgatcgccatccttctgctctgcggccaactggatggcccaagcggactgagttgggcagggtggtcatacctgtggagcctgtggctgtggttggaggccccgtgggcagctgaggcagcctgggtgggcatgtcccactgggacttaagcccctaggtgggctgtccgaagtgactcctgagtggctggggtgtgctgtccttccagcctggccgtggtggctgggtggtgttggaaggcactgaaggaagggcaggtgaattcgtgctggacctggtctcagtgccatgggccccaggagcccatgacatcactggcctcatggactgtggggattaaccctgtcactggacacccccaacacaccccctccaaaagaaaggtgttggcacaagtgaaaccccttgagtgatggctgggatttcaagctccagactggtccccactaggaagctctgggtctggctggtggagcaatgtgtacccgcgcctctgcgtctccctgcatctggcagccctcccaacagggctcatgtggggtgcagtgaagcagcaaagccccccaccccaccccaccccagactaaacacaggctgtagacctggcccagggtgagaagggcccctgtggaccacctacccaggtggtctgtggcagcctctcccagctttcggtccaggtggcccagggaggtggcagccctgacccttcctggcgataccctgattgatcatagtgaaacactgagctgggagagccaggggcacccagggctgagctcccggggcagctcccaggagctgcaagtggacctggcactaggaaggagcagtccaccgagcacctaggccagggcccgggacggtgccaggcaccagctgaggccctgccaggccagccgcatcttcacattcaagaccccaggccccagccacggctctgagctctgggtgtctgcagccacggttggcagggtgggccccaccttgccctgactgggccacggactggtgtgaagagctctaaatttcacttactcccccaaagtagaagtggcctaggactgtgtggtggctcctggtctccagaaccctgccaggctccagggcaagcagggaagtcaggcttagctgcagggcagcacctgtctgcacaccccgtcctgccacgctccctgcagggacctccgcctgttgtccatggtccagcttgctggatggggcagcagctcctacactcagagctctgccatccccagccccaggccaggctctccccacagcccgttaggccctgacgtcccctgacaaccaggagttggacaggcctggcccccaggctgccccacactgccatgaggaccccagctggctgagtcccatgtccaggctcacttcctctgtccctgcagcagtgagcacctgggaccatcatggtgagcaccacccaccttgccccttggcccatactcggggacctgggttccccaggtgatcagggtggcctgcagggcctgaggtggccatgccagccaaactccccctgccccacaactgggtcacctcttcaccctcccgcagcccttgggaacccagtgagctcctcccccttgctgctttgtgagtgctggcagtcctgggttgctgtcctggagctccaagacctcccttctggaaggctggggcttcctggtggaagatcccgctcacctcagctgtggcgtgggcctgggcttcagcctggggcagccctcatgggcaactgcttcagactggaccccatgtgctggggtggccagggctgtgcatggcaggttcagggcacagggtgcaggcaagggtgtgagggtgtgggagggcttcagtgggaggccctgatgctgagcagacacagtacagcctggtaaacaaggctcgtgtgctgggcactcatcgatcttggccattcgggcctggccaacagccggtgggctcaggcctgggcgggggctggggtgggagtgagctgcctcaggctgggccgtgggcactgcaggtggcttgtccggacagccctttccctggacccctcatgcccatggctctagctgaaaacacagctgctcttctctacaggctcgtcctggggtgaggagggtgtgggagctgcctagcccttcctttcccaaggggttgggtgcccctggctgaggaggagaccctcatggctggaacttggtggtggtcagagcctcctggaagttgaccagctgagctccagcaagtccatgcctcctgggacacagcctggccccgatgaaccctcagctgccatcatcctcaaagtcgcagcaggctggatgctgaaggcacagggggccgcatggactgtggctgcagctctctcattgtcatggggagggaatggcctgcagccccatcttgttcccttctcttaacagcctctttccaaagatggcccgagctcccatccccgcccccacagggctcttcctgcacttccccaggcatcctgggaggagaggtgggctgtggctggaatgtgccgccctctcaccctcctgccaggaccactgtgctggctgccttggtggcctggaggcctgcagagctgcccaagcgggggctccatgcgcagctcccactccatgttctgtccctggggaggcccacacagcactgcccctctgtctcattccaggtgcctggtccccagcgatccgccttgaccccagatgctcagacttgctagcccagggccagaggggcacaggacagggctttggagagggggcttcctaggctggtgctggcccagcctgcccagccctgccctgctcggcccctgcctgtctgggtgctggacctggcctgatccatgaagcttctcctagcgaggtgttttccaggcctttggaatcttagggatgatttcgtatggggaggggccttctccccagcctgctgtcttatttttgtgccgattccccgcagcccgagctcctgcccccagcacctgcctttccagcctgtgtcctgtcttccaccagcggactccagcctggctcccactgccacgtggctgcctggcgcatgctccaccccgtgtcctcccagggtcccagtgagggcccagccccgcagtgcgcagtctccgcagccatcgagtaggcggccagctgagcagaggtgctggccggctgccagcccagcacccgtcctgctgaagttgctcctggcacgcttccggccccaggcttccctgggtggtggggcagactttgtgttgctggtgtgcaggaagggcccacgacccccacccaacatgtgagaggggcatttggcagccatgggcaggacaccaccttcgaccatcagctaggggtatgtgcaaagggcctgagtgagaaacaaaagacaaaatggaccaaatgtgcttgtgtggccgggtgtgtgaattgtgtgcaggtgagtgtggaaagatgtgtgagcacaagcctgtcagcatacacgtgtgggcgtgggcatgtgggtgagcatgcaagtgtgtatacataagtgagtgagcacgtgtgtgtggacgtgcatgttatgtggatgtgcatgtgtgcatatgagtgtgtgagtgcatgtttgatgagcatgtatgtgtgggcacacgtgtgtgtgtcagcgtgtgctgactgccatggacgtgcacctggctgagtgtggaaatgtgtgtgtgagtgtactggcagtccaggttttacacccacacggctttgcctccccaggaatccgttttaatagcagagtgggctggaagggctggccaggccctgaggcagttttcaggccagcagtccctggctcctcatatgcggtgacagcccaggaggccggggccctcagagtgcagtctttggacatgcctggttgatggatccgtcattaccagcctgggagctgggcatgggctccggggctggaggacacccctttccatccctggccctggcgagcccggccctcctctcgccccgtgataacctgcagcctcatggggaaaggcacgcggaggtggtgccgcacccccagccctcacccctgctttgccaatcctggatcctggcctccgcccgccaaagtccaccattggccacaggatgtgggtgctgtgctgtgtccttgaaaatctgaagatgaggacagctcagtgggcgggggcgtttcacacattcgacacatgccctcacgcctgtgggtgtgtggcgggctggtttacagttacgtgaggatttcagacccaaagtgcagagcctgcagctgagcagtgcccagggagggctggggaggaaggtcccagccaggaaagtagggtgactctcatcagtggctgcggtgtccagctgggatgatcagggccgtgccagcctggtgcgcctgggggacccacagcagaggtcctgcatgcacttggctggcacgtgtagttctgaaggcccctggggaggcctggcacatgcagtgtttggggaccctctctgctgcctagacactgccacagaccccacacccaaccttgctgtttttcccccaagtgaggggagctgctttttccaactcggatagcccccctgcactgtgcagctcgcccacctccctcacagctattccagcatctctgggcgggtgcgggaagccggatgcagccagtaccgttgctgtttttggaaaagagaggttcaaggcagggagggcccagcctatgttccagcagggttgtctggctgggggggtctgcacctcgcccctgcacccccaggttcctggctccccacccccgtgcacgaagcccttcttgcctggcaggcctgggggcccccggccgccatgcgccccaccgcgggtgtgatttggcagcagcgttctcctcgccagcttgtttctcacataggggatgtttccatttttacagcagaaagaaaccgattccaagcgcctcagccacagccggagcgcgacggcccccagggagctgctgccacgtcaggtgctttgggggtgtgggctgctctgccagccgtggtcctaattgctgtcactcagggagccagctctagcctggggcaggcaggaaccatgaggggggtcttcggggcaggcactggtccctggcggaatccgaacctctgcctggttctcctggcaccccctccccagagacctggagcacctcccgactttgggtgggatgggcctgtggttctggaacaggagctttgcctgtgggaccctcccatgggggcggggtgtcctctcttagcccaggtgggtttgagccccacactgctccttccaccgctcagattcccgcctgcaggtccctgtcacggggctgctgaggaccgaccaaggtgactgcccatagccccacgccagcatggggcacagctgcctggcggctctgccgtcaccccccgtgctctgactctgtgctgtggatttgtgtcacctgcagacttgggtggcattgggcacaggggcacggtgtcctctgtcacttccccaccttgcttggggctggtctcccaggatgctgaagcattgaagtgcctcgaggactgttagaaagattttcttagaaagaaacatttgctacccagggcacagaacagctcctcgaggtctcgtaaaccagtgtggactcggccctgctcccgagacttggaggaaaggcagaaagggcggcaagtcacacgcaaggcaattttcaaagaaaagggcacaactcataggaggcaggggaaggattccatttcacctacagtcatggccccgcgtcttcagggaataggtgctgtctggtgcatcacattattagtgctggagggcatcgcagtcctgggggaggtcactgccagcatggcagcccataggaagtgggagggtgggattcaagggcaaggcgggtggtgggtcctggcccctgatgaggcaggtggatggtggacctgcctccaccctacccagcaggctggccaccagggcgtgtccacagactccagacaagaaggagagagtaaattgaggcatgtggggcccaggccctgggcgcaaggctggaggcctgaagtggcatcccatcagctggaatcaggattgcctcgatctttgattcttgagacaggaggagtgtggcggtggccccagcaggatccctgagatcttacacaggtgaggtggttgcagaagcactacacggggctggggcctgagggtgcagtgctgggtctaggtctccctgagagtccactgacagctgtggaaccaggcctcaggggagctgggtgcaaatcccacccctccacagagcagccgtgtgacccgaggctgttttgccctctctgcctcagtttctctctggcagccgctcctccctgggccccgacctgacccttcaggctcaggaggctgctccaggtccagaacctggtgctgcactgggtccagcctccaggcctttgctaatgttgtggtctctgcctgtgataactcctgcgagagctcctgatctcttatgaccctcccctgcctgggcagatgctcctcctgtcaccgagggtcccattagctggcagctaccctgccacttggtggacccaggtgatgtgggtgggcctcactcttcatccacaagtgggtgagaaaaggcaggaaaggaggtgaagccaaagatggcatgctccccctgcacagggtgactgtatgggggggtcacggcgggggagggaggggaggagagtggtccatctaagggccctgccagggcccaatgcaatgtcccatccttagatccatcttcagtcacatccccacgctagggggagcagcatttccaaaacgcctgccctgggggctctcagaattcaggggttccctttgaggtcacacaggccccactgaggccagacacagcaagtccttgctccttggcctaagcctgcaacccctgagcctcagtttcctgcagtaagtgggacatgatgcctttccactcctctaggcttctgcccatcctgtgtcaccgtcccagcagatgagtagctggtctggtggcctgagaccttgcttcactgggggacagggctgccatcctcgaaggccagggtctgggcctctgggccgggagctcctccatcagcttgcagccctgggggaggcttgcagccctggaggccactccctctagtgacagaacccatacctctgggaactgcttcctctgcctgcatgccccaaacttggacttggaggttgtagatggccgtggcagggcccttgcctggcccctatcctcctgcagcctggcctaggcatgggtgacttacccagtgccagcaggctgcctcagcccgtgcccactaaaaaatttgttcctggccgggcgcagtggctcacgcctgtgatcccagcactttgggaggctgaggcaggtggatcgtctgaggtcaggtgtttgagaccagcctaaccaacatggtgaaaccccgtctctactaaaaatacaaaaattagccgggcgtgatggcaggcgcctgtaatcccagctactcaggaagcttaggcaagagaatcacttgaacctgggaggcggaggttgcagtgagcggagattgcgccgctgcactccatcctggacaatagagcaagactccgtctcaaaaaaaaaaaaattgttcccatgatattccaaatacagtcatataccataatgacatttcagtcaaccatgggccgtgtatatagcggtggttccataagatgagaatactgtatttttactataccttttctatgtttagatacacaataccactgtgttacgatcccctacagtgtccaatagagtaacacgctgcacaggtgtgtagcctaggagcaaaaggccaaaccaaatagcccaggtgtgtagtgggctctgccatctatgcttgcttaagttactctatgatgtttgcacaatgacgaaatcaccaaacaatgcatttctcagaacatagccccatcatgtaatggcatgagaggacacgggcagaattcttggatgcccattttggggacagccaccatagtttggacattaatacatttgggcacatgcacatgagcacacacatgctcacatgcacatggatgcacacgtatgcgcgtaccactcactcccgggcacatgctcattcccgggcacatacacagtggggcggggcaggaaggctggatggggcccaggggagtcaggtgctgtggtgcgctggggctcaggcccttccagcattcaaacagagagtctcctaagaaagcagggagcccacagggcatgggatttggaatctgagtcagggatttgaatcccatcttgtgccctgggcatgctaagtctccctcctagtgcagtgggtgcctgctgcccaggctgcaggagcgtttgaggaggcttgtcagcctatagggaactgcctggcgtcctgctcagtgctgcaggctgcatgaggggccaattgaggaccccctaagcccaggaggggcagaggccagggaccagatgccacaagtatctgtgggtgggcttggctgtgatgagcaggacagggctcagccaatgcccaggggcagagcccccgaggcactgatgaccacagtgaggccagcgtcaggctctgggtcttgggtcttggtgctgctccaggagtggacccacatggcccctcagatgctgctctgtgactccaggcctgggtcaagccgacctctctgcttgtccccccacctccctctaggtaactaggccccaagatgtcacagcatcagaaatacagagaaaaaaaagcatagttaatactgctcctgctgggaaggcccacagcagggcggatggtagtgcacccagcaggtgtgacagcccagtctccccatctgcagggaaaccccatgccccctcaacccttactgcctgtcaccagctggaccccggtctctcctggctgctgtctcacctgccttcacatggtttctggttctttcatcttttcattataatttttgtttggagaaactttaaaagtaaaagaatgtgggccaaaaatatgttaacccattcccaccagacatgcaacactgggggggctgttcctcccaggctccttgggccccccagctgcccatgacccctgggtgtgcccagacagcagggggggtgtagtccacccccaccacgtccacagcccctgactctcgggtgggtctgggggctgctcgccctgggagagaagccatcccctcccggcggggccatctatcaggacctctctgacatcagcattttcctctgtggctctagcttcctgcctcctatctctgtcctcctgagaatgtcccatctgtcccatctttcccattagcagccctgtccttgagcccagtgcaagctccacagtggagaggccactcagcattgtaagtgaatgcttgtcctcgtgcctccctccccgggagctctgcctggagctccttcccggctccggtgaagctgcaggcagcatttcattgctttgacctgtcccagggcaccttccttctagaagggcgacttgaaaccttttcatcacagcacgacatatgcccggtcttgctttggtcatccagttttatgtgtcccattttatactcattttcttcccctcatgttttgtttttttcttttaactaaaacgatccatttattgagttaaaagattgtatattcaagacgttcactcagtatgtgatcctgcatagtaaacctcgggtgaaacaaagacaactatttttatatatttttaaaaatttagtggcatatagacttctaatattttggggggggggatattctttttttctttaattatggtaaaatatccataatataaaactgaccactcgaatcatttctaagtgagcagttcagtggcatttggcatacttacattgttgtgcagccatcacccccatccatccacagaactttttcatcttcccaaactgaaactctgtatccattaaataacaaatccccacccttccccgcccctggcaaccactgtctactttctgtctccatggatttgactacagtgtgtctaagtgggatcattcagcatttgtccttttgtgactggcctatttcacccctctgttttatacctttctgctgcgtggcgctttggctttctatgttctgcggcggtgggtggtaaagtggatgtcctgcttttaattctgagggctcgcttctcagttttcaaaaacacactttaatctctgattctccaattatcaagcatttgccatgaaatgatacttgctgctccccagcactgcagactgtgtaagagacatctcagccagcatttggattaagtcaaaccccaggaatccgcacctcctccacctcatcacccaataaaaaaggtaacgctgaggtattagaacattcacattagttccatgagcatgccctcttatgggcctgagagcacccaggctctggtgcaagccccccacagcccagggaagtgtttcaggactggagccctgctcagtgctgtgggctgcacaaggggtcaactgaggacccctaagcccaggagtggcagaggctggggaccatcccatgggctcccaggatggccttggggccacagggattatggccaggcttgtacttccaaagcccttccagggaggaaggcgctccacttcctgctttggcttaaaaaagtccagggaagcacctgattggcctggctcaggtcacatgacactccctctgtccaatcactgtggccaagagaatgcgctattgtgattggcccagcctgggtcagagccttcccctgctgcctggagcagggtctgtctccaggagagaggagtagggttcagccattccaatggcgctgccgcctgaagagctgtcagtcctactttgcagttgagctggctctgagaagaaagtgctctgcctagccctgtgattgatccacaacttcatggggactcaaacatgggttcttttattccaggtggagaaattgaggccccaagcaggggcagactcactggggtcacatggtgagttggtggcatgaatgggtgctccggtctacactgtaccacctcctccaggaagccttcctggcttggtcaagccaggcctggggtggtcaccacctgatgtcacatccccttgagacaaagccccccccctcccccgccaccaggcacctatccccagtgtccaggacatagctactggattcaggcagcttctgcagatgagctcccagccctatgtccaggaggtttctggaatcgacagctctccatgccacaataccctccatggctatttagggaacacccagtgtgtgccaggttcggctggcctgggagagtgcacagtggacactggtcaccaggagacacagggggccagtccacacccttccgcagtcgggcctggggaatgggttgggtactgacctggaggagggagggacagcaggaagggctggctgggcctcagctctcttgcttaccttccattctctcgatggccctggctagacacatgctggctcgcccaggccctactcatgtttcggcacaacgaccctgctctgcctccgtccccaagaccctgggctgtgcaaccagggccagacctgttcttcagccgcaccagggcctggctgtgcctctgcctgtcagtggccaagccctgagcctggagccatccagagccgcacggaacccacagcctgcagggtggggctagacatggctcctcctgcccgcccgtgggtcgtacaccagctcattagagccaaagcagcatcgattttgtgaatgatgagcatgtgtacgtgtttttggagccctggtgtgatttggcgtgtgcagctgatgattcaggggggtcatgtgcaaacgacacgccttataaatgtgaacccaccagaacgccccgttacggagatttacactgatccttaaacatcgtagattaatttttggaaaacatctataaaataagagatttatacctaaaacaataccctatgctgtgacaggaagggattagagtcaatttattcctgtattagtcaaaaactcaatttcatatattgtgtggaaaaattaaaaccctttctacattttattacaaattatgcatactccatatatggagataaataattgatagcattacaaatacttaatctagaaaatatttattaggaacagacaactcatttttcatgtgttttgttgagaacaatattgcacactttaaaaaattaatgatgactctttgcaaaaataaatgtctacatcctaattcttttgtttagcattgtgtccaagccaggcagacgcagccgggcagtgggcaggtggccatggagctgggatgtccactccctggcccctggctgtggatgggtcagagggctcatgtgctgtggcagttggccagggaaggtgcatttggagagtgtcaacatactgtttgtcttctgctgtgcaaactctcctcgacttgtaatttaaaactaaaagtgtttccgacttaatttctgagaaagcaccaagtaatgggatttgtggatggacttgaagagccaagaaatcaacactgactgcctctcgacctggagaattacggagcccatgaattctctgggcctcagctctggtcccaggctctgtgcacaaagagaggtgggcctggtgggtggtgcggagcttggccttgtacttcgtggctggctcagcctgccctcctgggacaagtggctctgccgggttctgtgtgcctcctggcatctctctgaggggagctcccagcctctgcctagaatacctgggcagcgtgttcagacctggggccccctgcaccatcaccccattccaggctgggaagcttgaggacccaggcagggaagcttgaggacccaggcagggccccagtgtgccacagggcttggccactgtgcaactgcactgcagctctggcctctggccgggccttgcttaccgacctctgccctctgccgtgtgtcctccaccttggccatgcacagcgggggctaggcgggcacatggtggaggctgccaatggtgccctggcaagttctcttcgccctcgtgccagccactccagggagcaccagggattgaataaataactgccacgtttattaaaaaataaatttggtgcctaacggaagtgctgtttctatacatagaaaaaaatgtttaaaataaaaaccaaaacagttctcaaaggcgctgtggcattaattattcatcgcttgctaatgaaaacatggctttgcaggcgtggcccccacctccctccaaataagactcgggctcagggaaagcctggccttaagggcagggagctggtgacccctgaataaaatgggggtggctgtgatatcctccatgggtatttagggagcacccagtgtgtgccaggctcggctggcctgggggagtgcacagtgggcactggtcaccaggcaggcacagggggcagtctgcacccctccttagtcagcctggggaatggcttggggtctgacctggaggagggagggagcagcaggaggggctggctgggcagcagagccacctcttggaggaaagaaatggggacagaggccactctggccagcaccagaggacagtggctacatgtctgggcacccaggccaggggcctggcaaacccccacagggtgggtgggtgaggccctgttctaagtcatttgatgacccagccaccctctcagatgctgctggatcccagacagagggagagagggaggctgcaggccttgccggaacctaggcgtgccatgcatgccccagcagccagaaccagccatgtggtggtgccacaccagaaagggccggcctgccaggcagtcaggggcagatgggagcaacttgggaaacagcagcaggagcctccactccctctgcctccacctctccagcagactatatggcacaccctgcccagctgtgtgcagcagggaaatttgtgccaggcctcgggcacctgagcccacactgggcatcgctgtcctgtcactgatcctgggcactgataggaactgtgaacaaagctcggtccagggccctgtggactgagctccccatcctcagggcccgggagcccctcctcctgcagtcacctggggcagccctatctctgtggggaggcctggagcatttgttcttttgttcattcattcgtttatttatccataaatgcccccgagctggctgcctggtctcctggggagaagggatgctgatcccatcagtcacctgcctgagcagggggtctgggaggctgagaggaagcctctctgagctgctgtgggtgcaggtggtatccagggcgacagctcctgggcaggagatgagctgtgccctgaggtggtcaagtggaaccccagcaggggcctttgaagctccgccagcccctggggcaggtcagggatggggaagaggctgcagggggcggcaggagagtgaggctccatctctgctgggtggctccgtcctggttagcaaggtctctcgcgtcctggcccctgtgctggctcctgggacgtggagtggaacccgcatccctgctgcccatgtgtgaggacccgggctgccagggctccagctgggccccaggctcagggtttgtgtgctggagacccagcaaagctggacagagcctggcgggacctggctctgcgatggcccagcttggtgtactcagaaggcctgatgggagctagcctggacaccttggcctgatttaagcctgggagccgcgtaaggggaggcagttgggcctgccgccgaaccgacgccccgctgcccccacttgcctctcccgccggtgggcctgaccttgctggaagcatccctcagcctggtatggatttcctgtcttcaccgaggccgcagggccagccgggcgcaggagccgagcggtggtcaggcccggggatggttttttgtttgtgggggcaggggctgaggggacccaaaccttccagagctggggggttttcttctcacctgtcactccgtggctccctttggtggctctttgtctggcatgggtgctgggcccaccctgcggtgtgggcagctgtccagcctagagcctgcctctgaccctggtcctatcctcagggccccttccagggctggagcaacagggacacaattgctgagctcagcctgtgtcaggtgcacaagtgacctcacttgggagacagtgcaactgcagtgggcctagagagggctcttcagctcccagtcacacagccaggcctggagaggtacacatcctggtccctgattcccccatcggcactgggtggactgaggagtggagtggggaccctgggtgggggagaggaaggaactgggcacagggggagagccagggaccagagggcatcatggagatgaaaggacaggcgagcccaggagggcacacaccatggcacggcaggcagacagacatagacataatgcccatatggcagcatgatctctcacacacacacatgctcacatgggcagcacactcacacacacgtgcatatggacggcacgctcacatacacacgcacacatgggcagcacgctcacacacacacgcacacataggcagcacacacacacgcacacatggacagcaggctctcacacacgcacacatgggcagcatgctcacacacacacatgcacacatgggcagcatgctctcagatacatgcacacatgaacatgggcagcacacacgtacacataagcagcatgctcacacatgcacacatgggcagcacgctcacacacttgcacacatgggcagcacacacacacgcgagcaacacgctcacacacacaacatgggcagcacacacatgtacacataagcagcacacacaatgcacacatgggcagcacacacatgcacacatgggcagcacacacatgcacacatggacagcacactcacacgtgtacacatgggcagcacgctcacacacatgcacacatgggcagcatgctcacacatgcacagatgggcagcacacacacacatgcacacatggacatcacacacggacatcacacacatgcacacgtggacagcatgctcatacatgcacagatgagcggcacgctcacacactatgagcaacaagctcacacacatgcacacatgagcaacagacacgcacacaggcacaacatgggcagcacacacacatgcatatgagcagcatgcgcacacatatgcacacatgagcagcacgctcacacatgtaaacaggcagcacacacacaagcacacaagagcaacacacacacatgcacaacatgggcagcacacacatgcacacaagcagcatgctcacacatatgaacacatgggcagcacgctgacacacacatgcacacgtgagcagcatgctcacacacgcacacgtgagcagcatgctcacacatatgcacacatgggcagcatgctcacacacacgcacataggagcagcacgttcatacacacatgcatacatgagcagcacactcacatgcacatgtgtgcacatggacagcacacagatacacatgcacatgtgggccacacatacacacacatgcacacatttatgcacatgggaagtatactcacacacatgcatgcacacatgggcagcacattcacatgtgtacatatgtgcatacctaggcagtatgctcacacacacacacactcatgtgggcagcacacacacgcacacctggacagcatatttacacatgcatgtgcagcacacatacacgaggcagcatgctcacagacacacgtgcacacacacaagcacactcagaacaagctgtggggcctgcggtgaggacaccaggcaggcaaggcggctgctgcagaaataattagtcactggtagacaggcctggctcaccttctccaaagccaaaggggggctaccagcccccagctctgggaaagggctctgagggcccgcccccaccttgcagtggttcctgggacctgcagggagcatcccaagcacggcccgtggggtgcgggactctgccatgtgatccctgaggctgggcctggccggacgtgccttggcccctgcaaaccgtgcacatccccaggtcccccagcacagcagcagtgcagggagtggagacgtgaagatggggagtggagacgtgaagatggggaagaaggaggttggaggtgcagggccgccctgtgttcttgttggagtgggggtaggagcactccaggtctggttgggccctgtgagggtgttggggaccccaggccaggcctgggtcggatccatcactccctggaggaggcatctgagtccagggatgccggacaggctggtcccaggtccccaggctgactgggcctcaggcatatgggcatctgcagctgtctggggccaggcccaggctgaggggcagccagcagggtgcaggaactcccaggccctcagcttgcagcgcagagaagggtgactgctctgctgttaaaacaatttattttgctcttcaaaaagctaacagctgtttacagtcagcatgtgggagctgccccctgggtgatggattctgccaatccagccctcccttgccttccggcgaggaggggtcatcccaggcttcgggtcaggatgggcagagcagaccactgggggccaggccatgatgttcctggccactccacgtcccctcggctgccgtcctgtgtgctgccctgggagagtgcaaggaagggtggccccctgaggctgatacgaaatggtacggtgatgtgagggggtcaggagggaggaccactgtgggaggcgtgaggtgcagtggaaaggtcagggagaccttctgagaaggccagcagggagggctgcccagggcctggagagcgtgcatagctgggggcagggtgggggcagccggcaagggcaaagcccagtgggtgtggcgatgccctgggggatgggccccgatgcccctaaactggttcggctctctagaccagactagtgtgctatgtcggagccgagcaacagtccccctcaactgtatgcatgtacagtaggcgctcaacagacacttgctggatttgacaatagccctggacggaggactgaggcctgggctgcacacattctgggctcctgcaagcccctggcagccctgagctggtttctgagtgcagagggaggggctgtcaagggtggaacccacacatgccaaagcctggaggccagtgcaggggcagggcacctgctgcctcgggacagcgctgaggttcaaagccacctgctggttcccacctgcctggcacaggaccctgtgtcggtgggggtggccagatagggcagctccttgtctccctggaacctgtaccctcagaggtccaggatccctgggggaggttccggggctggagagacggcccctgtggcagggcagggacagacgggctgattctatctaggatgggggcacacaaagacttcctgaggggcgcttcaaggccacagcaatctaggtgggacagggacatcagtcagaggtgccctgtggagacccccaggtccagctcctggtactgtgagaagccagttgttccctcgcaggccgccaaggcaccgcacagtcctggcctgagtcgttgtggggtcttggggaggagggttctctggaaggacactgagcctggactttggggcaagagacccagagcccctggatgcttgcggcctcaaggcccaacatgcagccaagcaaaagctgggggcacaggcaggggatcccctctggggaggatgcagaagccgagccaggctgggccgaagctccttacctgatctggtgtcctcctgtgcgatggtacaagagcctcagggcacatctggtctctgtgacaccccccgagacacccggggaatgttcccaatgaccactgttgggccactgcccgaccacgtcacggttgcccctgccaggactcaggcaaaacccagctgtccctggcgctgtctcccaacagccctgcagggcccagtgctggaccagggccttgtctccagcctctcccccatgggactctggggcctttgggggcccttgggggccttcctgcaccctcacacctactcatctctggactcagcctcagtgtgaatgctcacctcgggctgagccaacccctccagacacgttctgcagctcgaggaaggaactgccctttgcagctgggatctgcccgagtttcagcagcagccttgaattgtaatcccgagcggctggcgaataacacagcacacagcactcgagagcccaggtgagtcctaagtggggctgggctatgggatctctggcttctgggcctttctcagaacagaccctccaggccactctcccctacatccccggttgctgcactgggtgcaggggtccagagccaggtcagctgctgcccagggagagggccaagactgcagaccccgccaagcctgggggcagccttcctgacaacagcaccatttgctgcttgggatcagccaggccggctccccgcagatgggagggctgtgaggtgagcaccagcgagcccctggaggtgccagaaaatgccagtgtgggcaccagggggcttccttgggctggcatgtcaggggaagcccactggggcggctcagtgcccatgatggaagctcaagtcccacggtgctgccccaggagctataccccagtgagggtcgttggctggcgatgtgtctggctggcatgggctgcctggtaacgaggggggcccatgtgtgaggagccttaggtaaggatccagctggcacaccgaagaccccaggccaggggacacaggctgggggagggggctacagagacatgaacccaaaagagaatgtctgctgacatcccaaccctgacagataaccagctgggtgacaggtgggggctgtgctcagatcaccctcctctgtcctgtgcacatgtgtgggtgcatgggagtccatgcgttgctcctggcttgccccctcctctcctcggcccagcttgtggtgctgcgctgtgcatggagctcggtttcttagcaagttcatgccatgagccgccagctaggctgaggaggagtgggtctgggtgccactggggcggtctgggcttccctcagctccagggctcttgcccttgctagcattgctgtgattctcaccattgcgccctgttacagaagagacaactgaggcatggggaggtgatgggacccccagggccacccgcaggaggtggccagcccagcagccctgcccagtcccccgccggccttgtgctcccatctgggcccctatctgtagtttccccagttaacaaaatcacaacagtcattcctggttgttcttgctgaattctctccatttgaggagcagcattttggggtctgtgtcctaaatggacccaatcacaggagtcacccagggcactggctcagcccaagacaacaccttcccccatgtggacacacacacatgggggaaagaaaaccttgccaacccgccctctagcaaaggggcctggactcgcatttttaacaagaaccaagagatcccgtggaggaggtagtccacagggggaaaaacacccttgagtctcaagtcccccgtggctccccagctctgccagtggctgcatggcgggtgagatgatggtggctcttgggtccctctgagtcttgctgcccaggctggcaccggcacattttgtcttggctccatgctgtcgggccctgagctgggcactgggctccctgagtctcgtgggagctgtctgggtcctgaagcaagtggtggcccgagcaggggaggcggtccccaccctcggggacactgtctgctccggctgtgggctccgggggctgagagctatttcggctgcactggcctctccactcctgccaggcttcagtgagctaagattgtgccaaagtcaacagaacagaaaagagaggctatggcgctctgtcagggagaaagcccaattaggaggggcttgtgggggcagggcgggagtgcagagggagccccggaacctagccagcccactgtgatgacagggccttcgacagcagcccagcacttggactgtgcagaactgcggagatggtgctgtgagcctggggagggtgcctttctccccaggggcccgcatggggccaagtctaccagacttctgagccggcatgtctgggtacaggacctggccctgcagaactagcctgggcatcagagcccaccagaggtgactgccagcggccaggacccaccacggagtctcagggagcagcacacgggtggggagcgggtggagggcacacaacgctggtggggcatgggcctgggcacctctccagctggacactgcacatgacaccccaggccaggccagggtcccctgactcacagaccccaggcacagggacatgctgttttccttttagtccaagtgtacggggtgaggagctgcagcccccaccctgagggcctgctctgtttagagggggtgccagggtcctgggtccctccctctgttagagctgtctggaaatcctgagtcgggtaggtgaggtaggaaagggagacctccccacccactgccctgcctgagcggctcccacggtctaaaccctgtcttgggggtggttcccaggaggaggcagcagagcctggtgaaaagagaccagacagtgtggacctccctggccctgggatcaacagcctctcctgggcccagcttccccaggcctgagcttggggttggaggatcggcaggagagtgagtccatgaaggcaccatccccacccctcagcaccctttccctccatgtcatctcggccacccatctcagagcccagctcagcacccgggccctactgggccaccccgtcaggccctgagtccccatggagggtttggaggctggaggccggtcagctggggaggggaagggcagaggagcaggggtgagccacttggctcagggctgaggacctctcgcactctggccactgcagagggtgtccggctggggcaggagggctgtgggagagagatcacatcgtgtgtgggaggggacagtcccctcctgcccagtcccctcctgcccagtcccctccccacaaggccttagggaagggtgggggtgccacacaccatgggctggtgcccccatcctggctttgcctacctaaggctctgggattggcaggcatggagttccccagccctgagcgtggcaggggcaggatgacagacccacggtcccctaagccctccctcctccacttacaccctcgcccgccagaccccagtcattctcctgccctcagggcctggattcagccccacccccagcctccttgtaagcccggccttattagtgctgcttcaccccgactttgcaagtcaaattccgcattactgcgctcctgctctgtttccaccttgatgcatggagagctggagagcagctggagcagagaaggcactgcaatgaggcggcaacccgtgctggccaggggccccagggcccagagccaggtggggtggaccccgaggccctgtctttccacaggtgtccagggtcactcccaccccacccttggcctcctgctggctcagccccacacccccaccaaagggccaggctccgggtgagtgatcctcagggcccccgcacaggctgttccctctgcacacaggctatccctgccttcctgtccagccagtgggtggggagaagcgagtccctcctttcagggattctcaggaaccgagtggctatcagggtatgcagctgtgatgcacgtggcaggagaagacctcagacgccacagcctagctctctgtggggcaagtgtgtctcagcctctctctgaggagaggagagcccctggactggagggtgccctgctcagctctgcctgggtattctgtggcttgcagggtggaaggtgaagggctgcaggcgctggccttcccaggccccccactgtctgcccagcttttccttctttggcagccccagttccttccttatacccagtgggacagcagggcccagccctaggggccgcaggagacagacatgccccaactgagacagacaatggccagcatggcaggtggcccagtctcggccaccaggacgtcctaggaggtacggcccctcagctaagctggctgtccttagtggcccagctctggctctggctggtcctgtgaactcaagatggcagacactgttcctggtctcaggccaggtcttgggtgaagaacgttgggtgtaggaccctgtacctctcctcctggaacacccccagtggatggcgaggtcactgaggctccatccaacgggcagcctccagggcagccctcgctcctcccttgccctggaggtgggcacgggtcagtggaaggatgggactgaggggctgggcccttcaccgaccctggaaggtggctccctgtggccttccctgcagtttcctggtccagtgtggttcagcctaagacacaggtgaaggcctggttatcacttggctgcttttgccaaaagagtggcttccagtgaaatcctttggctgccgaaaggcaaagtcaccctccctccctgtggccccaacacctgcagggtttgtcagcagaaggttttcacggtccactgggcattcgcgggcctttggcatcctcgagggcctgcctttgattagcacacaccctttgcttgacccagagggtccagatggcactggctccacggcatggccttgagaattgaggccggcttcggcgaggatggtcccacctactctggccttcaggccttcaccaggagagattcaggctgctggcccagccagtctctgcagggacaccccggtgggcccagggagggactggggtcagctggggccctggacttacagtggatcccacttcccccacgtcttgcttggttctgggcataagggtcctagttcttagggcctggcctggccctctcactgctcccgggaaacctcgggaaacatggcaggctgtgttccccatcctcaggctcccaagtcgcttctgtccagtcctctgctggtatctgtgactcagcaccatgacggggccctgtccagggcgtcctgggcagaaggctgctccgagtgcacagcgggcacccccatggacaggctgcgtccatgtgccactccttggccgccctctcttcatctgtagtgatgacacagtgacccccacctgcaggcctggtggcactgctgtcaccaggcacagggagcctgcccccaacctgggtggtgttgtgggagtggctgggcaaggaacgctgctatccctgctgagctgggtgggcactgatgggcatggggacctggagtgctgacccctagccctactgtcggcaggccacgcctgcccctctggggaactgctgtgtcccccttggctggcctagaagtgcctagaaatgtcttttatgtggggagtcggtgggtgagggccccactgtcccatcccttgaggaagggagggctctgggcagggtctgcaccaattccccagtgcctgctgaggcctgtggctgcctcagggacagtgtcagtcaccccttcaccctggcataggtgtcctatttccagagtgtagtgctggatgcttctgtttggctgtgttaattgagaccagcttttacagaatgagcctcttggggtgggaaaatctgcacagccttggtgtttagggtaacctgaaagtggagagtgagcctggggtgcagtctcactcccccatgcccctgggcacagctacccacaggcccacagcaggcaggcaggactgatgccatcctccagatcccccgaccaggcccagaggtggggccaggagagatctggggagttggtgccaccagatttcccaaccatgacaggatgtcggggggtggggggcaacagcaggactgccccaggctgggtccccacccaagtgaggcttggtcgtggcctcatggccagtttgtccctctgcggatctggaggggtcctcggctgcagcagggggcccagatgatcctgacctggggatgggaaggcctctgtccgtggttccccagcagagcggggcctgttgagaggagcaggggatggtctgttgaaggagtcggtgaacggagaggcatgcagggatggatatggacagggcgggtgctcagaccctacagtctgaggtggaggggtggggttggaggctggaatggccgcgggggagcctagaggggtagggctgtggctccaccactgttggctaagggacctcagggagggcttcagaggctggggccctggctcccaaggcctcaagaccctcctgctccccctgaaggtagcagtgaccgcctctcagaaacccctggcatccctggaggctgcagtcccccgccccgcctccactctttctctctgctctgtcatttttcaaaaataattgtgcagcagcaccaggctgtctctgtgcccctcctgtaggttgccctaccccaccaggtccctggctcggcgtccccagactctgccaggctggcctcaccgtgtgtatcgaggtgttctccctgcaaggtcttcatcattccccaattgctcgcatttatttttctccttccttggtgagtggccctgccagcctcagccttgtctctccttggtgagcgtcattaatgcagcttccgcgccacgatcagagggggctgcccccaccctgccggccctgccgcttctcctctgcccgcctcgggatggatgttcatttattgcccataaatctctgcacagccctttgtaaagacaaattggaggcctcctgttccccggtgttggttgggccgatcggtggtgggtttaattggcccttcccgtggaggctgcccctgcaggagaggctcgttgtgggctgggccagatgcactgcgtctgcagaaggggccattctctgcccctcattttgtctagcgtctgaggctgggccatgtgcagggacaaagtgtggatcctccctcgggcttccaaaacatggcctccccgcattcacgtggcctggcagcagcccaggcccaggcagggccctctctcacccagggggtgatgcctgcagcttcaacagcaacctccaggaaggaggcgcatgggttcgttgaggtgatacaggagtggaagagcttggtcccttgaaatgaatgatagggaaaaggggaagtgctgcgtagaggagggtgtgatccctggctggggctccatcccacagacctaggtgaggacaggcatttttgcatttcccaagaccaccctggcctgccacacccccatcctatgactataaaaactcgcgagaccctggcaggcacgcacaagctgctggacgtggagaggagcggattggcagaggagcactcaggcggctggacgtcgagaggaacgcactgacgggcgccggcaccccggcaggctaccaaccggcagcagaatgacctggagtttggctggggcagccagaggagagcccgggcccgactccaggggaaaaccgtcccactccatcttcttctgccttcccccatctgctacctccactcaataaaaccttgcactcattctccgagcccacgtgtggtccaattcttacaccaaggcaagaaccttgggatgcagaaagccatctgtccttgcgataaggcagggctctaactggggtttaattgagctgagtaacagaagccaccgatagagttaaactaaaacagcaaaactaaaagagcaccctgtaacacgctcactggggcttcagctataaacattcacccctagacactgccgtggggttggagctccacagcctgcccgtctgtatgttcccctagagatttgagcagcagggcactgaagcaagccacaaccccattgcatgtactgtgaggggaacaaggggacttttcctgtttcaccagcacacagcaggtgcctaataaacgcacagcgaactggtcagagagagagggaccctccaccgagcccagccactgcacaggctgggagggcaggactcctgccgagcttggcaccctttcctgcacccaggtggctgtgagcctggccctgccccggtcagcaggcctgtgctgaccccacatgcaatctgctgttggtgccaaggaagtgctacctgtgcagctctcagaatgtcaggctgggtgctcctccactgaggtcagggtcaagagaccctaggccagctctggggggcccacagggcgtgaggggggtccaggcagccagcccggcccagcctggttccactgcttactgtgtggccttggggggctcccttggctttctggggcctggggaaccaggcgcgagcttggtcctgtggtctgaatccaagaagacaggttgtgggtggggacatttggagggagggacagcctcggcctcagctttgggaccgtgtggcagaagcaccctgtctggccctctatgagctcctccagggctgggcccaagcagggacctcttcttccatgagggtttactcattcctcaaaacaggcacaaaagcagagggctgttgaggggtagtgacctgcccctggctctggccatgcgggtctgggcactgtggatccactccatggccacctggctgggtgaggaccagcctggaggatcaggaagagcttcttggagaagggagtggtgtcagaactgaatactgagcaaagaggaaggaccaagaagaagatcctaaggagttctggggctgggggctggggattgggagcaaaaggagagatgaggctggacaggtgcctgttcctccacccactggctcaggactccaggcatggcccagcaagggtcccctgcccctgggagcaggactcccctgcagcagacagaggcaggtggggagtgcgacgcacctggaaggggcttccggagaggtgtgccctggcagagccccacctcccccaggaaaagacagtagcaccaggccccagccctggagaagcctgaccaaccagagaagtcccacggcctcctccatggagtttggggctcctcctctagacctgggattggcactttggggtcaggccagctgctggggagccctgggccccgacacatgcaccctcccaacaggagtggggctccgggggccactgggctcatgcccatcgcagccactctccaaggccttggcataatgggatccttgagctgctgtgcccggcggggtggggggggatgggctgagatacaccctttgctgacagtggccattgcacttttcccacccaggcctcatgtggggagccctgccaagcccaggctgtggtgtacacaggggctgggctgcagggcagggctccggagcggcctagcccagagcagggtgggaaaggagccagctggggtccaggcagaacagaggccaaggccaccagtgagaaatctgggcatgagggtggccaccaggccggcaacgtgggggaaattgagttgagggctgggcctcctcactgtggctggaggcggcccaaaggccagctgaccagacacagagctgcctcagtcacagaggtgccacagctcagggtgccaccccgagtgacatccctaggctgactgacacagtggagggaattgacacccagggtcttgtgatgtccccgggcactgggatggagaagcagagcagcactctggagcacaaacacagttggcagcgaagggtctgctcccgcgtggcctcgggcccaatcctgcctgacatgttgcttcatgtctctgggcctccgtttcctcatctgtgccctggggacattagcagtgtcttcctgcggggatgtgagtgtgaggtgccctaccaccccagggaggctgtgagctgcaggcagcccggcagtgaggagcccccacccctgccgccgccgcagtggcccgccccgggccccagctcacaccacaaacacttgcctccctctcaacttgtttccggcatgttctcagtctcgctggatgttagtttaccatcggctgctgaacattcggcagcttctattatttcagaactaatttaaggattaaaaagtaattctcccaattactaggcaaagccctgggcagccagataaacagggggcaggcgctcccatccaaggacagggctgctcctgcagccctgggcagacaggtgtgcagggcagctctggtgcagctcagcccccagggccgcaggggtggagtcggggtggttgagaggaatccccaggagcagcccagcctgggcccgacatctgagggttgcttgcccctatcccccacccaggtcggctacagccacctagtggtgagcccagccccagctgtcacctccaccaattgtgctgggtggtgctgccctggctaggcctgcaacacagggacaggcccatgagctgtgaaggattcggtccacagggccccctggggctggccaggcatctttggacggggccaggagagtctgtggtagaccagcagcccgcatggggtgggggccaggatttgataccctcaaggctgattcacgcagctttaattagctttctgcacctgctctggggtctgggtgatcaaggctggacaccagctgccacccccaacccctgcctggtccagcacctgacctcaggggcccagccggccggggctggtcaggcagagctggggagtgccggggtcggcgcaggaaggagctgagtccctgggccctggcccaacgccccgcccactccgggcccctcgtcagcagcggccggccggtgagctcatctcttcctgggctgtaaatatcacccaagtgctcacgactcccaaatgtgtcctccagccgggcccctctgctgagctcagcctgcacagcccacgcgacacccccgcccagatgtctcctgggcctcgacaaagcggccgctcctctcggcgcccccacctcagggacgggcgccccgtgccggctgctcaggcctgggagccctgcctgccgcctccaccccatgggagcgtccatgcatcctgctgagtccaacttaaaactcgtccacttccttccggatcctctcaccccgtcctcaggtctggttggactgtgcccaactccccacccctgccactgcacaggcccccactgtggcctggaggggagggtgcagagccctgagggcagctggtggtgacagtcagccccgaagctggcctgagggcgacaggtgcctgcttcttagttaggagtgggcccagcagaggtaatgaactccttgtcctgggaggtgtgcaagctgaggcaggatctgctgtccttccacaagccattgagggcgccagcatccactgcagttgggtcactcaggtggggctcaaggctctttggaaatgggtggcttcggtttcctggctctgactgcaaggagcccccagcctcagctgagagcactagcccagatccagcagtttagctgcctcttctcaggcatgacaggggccacttgggagaaaaactgaataaaaccctgcctatgccagtgcccaggcacagcctggcagaatcctgggcctggctgtggggtcacagagactgggggtgccaggggtgctgatggtagagctccaggcacaggacagagactgcacaacattttgacatcaggccatccatggagaggcctctgctggggctgccaagggtctcctgggcccagaggggctgcagagggagccctgggcaaacagcaccccaccccggcagggctgccctgcctgagctgcccccagccttggggcaaggctgccggccctggatctcaggtgagcagaggggcaaactgcaggtggaggtgtgcgcagccacacggggggcctcagcacctgtgggcacaggcacagggtctctcaggagagacaggacatgtgggaggaccctgaggagggtacaggccagacaggaccactgcatcctggctctgccctgtgcttgatgggaggggtctgagccttgggccgcagcacacgcacagagaagcgggcggaggagctggggccttggctgctaagcgcgtcctccccgcttcttctccctccttctcctccccccaggcttctggagccccggccgcccccacgaccatctggcttcaccagcaacgctcccccacaccctcccccacgtcactgtttttctccctctccccctccccagccactgccctggcggggagggggccctttcctgggaaggcttcctggccacgtggcccttcccttttgtttctgagtcctcttcggcccaggccgtgggaaagcgtgcctgtgcatatttctgcctgtgcatatttttgcctggatgcgtgtgctgctctcgagcccccggtgcctgcatgtgtgtggacatgtgttccctgccctgctgtgtgtgcatgcgtgtatgcatacatgggtgcagggacatgcagacccaccacggcctatgtttggggtgtgggcatgctgtaagtgggggtgccccagacacgcatgtggggtctagtgtgaccaccagcagcggtgtgagggtgcatacagcccccactgggccttgaggccaggcctgacccgcccaactctccttcagggccttcctctcctgccacccaccaggggtaggaacagggtccctcatcctcagcctcctcctgggggctgcccgggcagcctgattggggtggggggcccgagagcaactgtccccacaggggctgctatgtccagacccatggacctggcatgtgctccatcagccaggctcaacgacgtcagccaccaagcatgctccatctgtgcggctggggggccaggggcacctgacattggagctgcccttggccaaggctgtcccacctgtggtgccaggcaactcccttcctctgggggccttgtgatgggggagaggctgcccgtccagcacccacccctgcttctcaccgcccacagcaccctagcctgagaggccacagcttaagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctggcctccggcgagggcccgaggtggggaaccctggtggctcggagccctcgggccgcactgcagtgagcgggggctcagcagagccaggcagagtcccaaagggtgagtcattgatgtgccgtgggccagagccgttgcccggcgggctgtcaccgggcggcacgcgtcccttcagcgcattgcctgccgaagctggtcttccaggctccagtactgaggccttgtcagcggcatctggctggcagcacttgggaagccccagcggctcctcatcggtggccctgccggtccagatgggatggtaagggccggtggccacagcgcagccctgcaggtcattggcagctaggcgtttgaggtcacggccagccaggcgttgcgggaggctgcagggcacctcggaggaggagccgcggaacttctgcagccaggcccagagtgggcgtgcccggcagtcacacacccaggggttgtcgttgagcctcaggtactgcagggcacgcaggggggccagggcctcagtgggcagcgctgatagattgttggcaaacagatagagtgtcatgaggcggccaaggtcacggaaggcatgcgggtgcacatgggccacgcggttctggtgcagtaggagacggtcgaggctgtgcagcccacggaaggcgcgctcgggcacgctggagatgcggttgccgtgcaggaagaggtgtgtgaggttgcccaggtcgcggaaggtgtcatcaggcagtgcctgcagcgcgttgtcctgcaggtagaggtactgcagggcagccaggccgcggaacagccccgggcccagctcctgcaggccgcagcggtccaggtgcagcgtgtgtaggcggcccaggccgtggaatgtggcagggtccacagaccggagctgtgcattatcgctgaggtccagctgctccaggagggccaggccagtgaaggcagccgcatcaattcgggccagcacattcgagtgcagccacaggatggtgaggttgcggcaggcacggaagctggcagctggcacatgcgagatgcggttgccgtgcaggaagatgcgctggctggcagcagggatgcccacgggcacagcctgcaggccctgctgggggcagcttgtcgtcaccttgggctcattgtagcatacgcaggcacctgggcatggggctgccacctgccaggcctgcagccacagcacccatgccagcagccggctccctgtgggcagaagacagagtggttagcaggaagggcaggggtactggagaagctggaggttttgctagagccaggtgggccccggagattgggtctcaggaggacctggggctgggtccaagatgtggccaccacccccgggaatcgcagtgttgggatccctgcttcacaggcctcatggacgatgctgggctagaacatgccttggagccatgcactccaccctggaagccacatctgcagactccccataccacacccaggagcagcccactgggtcaccaggggcactcacttgaaggcctcctggaatggacactggtgactgcaggtacctcctcaggactccagtgaacacagagcccgcattgcaggagtccccggggggtcccagtgggggttccacccacagggcctaggaaacactgcaatggggctggggtccctctgggcacgtctatctcaaaaacgggcgcctggatgcccgagggcgggggtggagggcaagtgtgtccagggcttaggaggagtcgcgtcccacaaccacccaggcagcctgctccctcctccacacatcctcctttcaagcacttcctgacttggcaggaaccctcctgaagcctccgccccctggcctcattctctgctccatctcctccctgggaggagttcactcctccccagccaacccctgcagtgccagctgcctgcacccctcccacccagacgccatcagcagggatagcctcccagtgggttctcccccagccccaggtgcctgcaacccctcctccattacagggccagatacacctggggcttcaccaaggccctacatgggcagtagtccctcccggggtgccgcatccagagctggtctcaccagcggggtcacccactccggagtaagctttcctgcctctcattccaccattgagcccccacccctttggaatgctgaagattctttctgccttcagcagtgagtctattaaaatgtgaatccccctgggaaggttatggcttatcagctaacacttgagttatcagctaacacctgcgttgacagctaacaccttccacggcagctggctaagagcaggattctgcagacatgaggccggctaagtgctggggttggagccgggcaggaggaaggagtggaccacaggccagcttccccaacctagaactgtgaccctggggccctcctacccacatggggcccctgccccactgggtcctctctacttgggcagacagtgcagtcgccctaaacgcagagcccagcaagcccagcacgcgcagtgaccgctgggcatgtgcgtcctcccagactcaggttcataggtcctcagaccccctccccacagcctgggggcctcctctgccaaaccccctgccccagggccatttgttggctaccagggagatggcagcccagggatgggggtccggaggcccctccctgggtgggctgggtgaggaaagcacctggcctcgtgttctgtttaaactgcggacaccctctctgctctctttctacacactcttcctaggaaggtggggcctgaccatgtcagctccccactgctgtctcacctgctgtcaccagagggaaaactgtgctatgtaaatggcacttcctgtcctggggccaggtggggtggaggccccacatgctcatggggcagggtcaggactcactgccacattatcgaccacaccacaccactgactgtgggggtcaccaactgagccttgtcaccaaccataccatgcggctgactgcacccaccaagactagccacccatggtggccacgcccgccacattaccactgagccatgccaccatcccaccactgtcctgtggctccaggcccgaagctgtgggctgtgagtctggctgtggtcagggctcagctcactcgccttgaaccgagccctgtgctcatggatctccctcccgaagcagctgtgtgtccactctaaacatgcccccagtgaggtgccagaactgagccacacggtggtgcggggtcgggggagacaggggaggacatgggggagtggccacgtggcgctcagttctgccaggaagtgggtattgggcgcaaagacacggctcggttcctgccgagacaactgcttttcgtaaaccaacttctgagagtcgggtgaggtgggctctctcctcgctgcagccatggtaattggctccagcctggccccccttggggcctgcccgctggtctccatggcaacccctctgctgagcgagcaggagggggcatctttttatgagataatcaaacccaactttgcagcatgggtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaactctaataggatgctctactgtccttctggagatagcatggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccatggatagcgtgcctgtccaccgtccccacccaggttggccctgcggccacctgagcctgcgagggccccagagggctctcctcagcctccaagctgcacacaaactggtacatctgtgcctctcccaccctcccaggccaattaacatctcttctttcctccagggtctcctcctgggacctccccggaggatggccctgctggctgtcagggctgggtcatagctaggagctcctgtctcagcccaggcctggctcaggagccacagtcaggggagggctggctctcctgcctggaaggctctgagctttcccagcggggacagtgaccggatactgacccagagcctctccctgcggcagccagactgggcagggtaggacccaggatcaccaggctgaaggcccaggaggctgggcagcaaacagtccaggacgcatccccctgacgggagcaacaggcagcccaggtgggcacctgcaccatcagttctggtgagtggagggctgttcacgttcactgcaggagggagtgtggcggggggaggaggaggtgggaggagagcgaggagggcaggagcagaggggaggggtggagaagggggatggggaggtggcggtgggaggctctggggatatgcccagccattgggcaggcaggcggctgctgaggtcagcagctcaccccagcagcccagggagctgagccgagccgagcagggatggccttcttcatgtggtccctggcccccactgttcctggggccccgcccacctccgtgccctcccaagcttgggctgaagttccacagggatgcctttgcctctgcccagcgatgccaggaggcagcacagggcaggcagctgtggaggcgccgagcaccggctttcatccacgcacagcttggtgccctcgggccccaatgccgcccctgggctgggatcaccggagggtcccatcacctgctataaaaagtgagacagcaatacatttacagattaggaaactgaggcagtgagtggttaagccctgccctgctcccactccagactacccaggtggagaggcggccaagggagacactcacagtgctgcccggaggggccacgaggcatgtcctgcccaagcaggaaggctggcggcctggctagtaatgggggagggtgtggaggggctgggctgcaggccacgtgcagaggggcaggcagcgccctcctgtgtcatgggtggccgggaggggaatctccagggaggctctgagctgctgcttcccagggctggggtaagaggctgcagagggctggggctgggggtgggaccagctgtagcacagccgggacatcagtcagctcaggatcctctcggacaccagccatgtccccgtcaggcggtcacgtcacagaccacagttatgaggcagaacaggaggccacagctcagtgcaccaaggccagaaatagctccaggcgggggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgtttcctgtgcccttccagggctccaggtgctgcggcaggagattggcagcagcttctggtgggggcagtctgcccttgaggggtcctgagtctcctagggaagtgagtaccagcccctgatgccctggccctggcccctgctccttgttgatcttggctgcaggggcagggtaggcagaccaggtcaataacaggcaaggacacctgccatggtgagaggtcactggacccagactgaagcagctccaggcctagctagctacatgctgtgggggaaactgaggcccagtgtgggcagagccttcaggactggcctcctgagtgtgcctagtgcttcctcagccccctcggctccactctttgccctggccggcagggctcgtccctgccccgtgatgctgggctcaccagagacaacgagatgtaggtaggtccagggccagcaggccaggccagaggctgggcccttcaatccagcaaattctcttggagggggtgtcaagtttattgacccattttacaaatgaggaacataagaactggtgtgggtataatcaatagcaaacacaatccaaggtcaaatccaaccatatgctacttacaagaaacatgcctaaaagtacacaaaatcttgcaattaaagatattatcagaaaaataataacaagtaaagcaggagaagccacagccccagggctagcgggcttcccagtctcatggccccaggggtgcgaaaaggtcttgctgggcagtaaaggctcagccacccccgctcctaacctgagctccacagtcctgtttccagccagcagggcacctgagagggtacacctttcaagtcacagacactgaagctagcagaggatggcctggcccaggtgagagctggcagccctggatggcaccctcaccccaaggacacatcaacgtgggccacaccgtgcaggatcatccactcgcttggccctccctccgtaccttggcaaggtgtgaagtggcccctgtcccaggtgctgtgctgagtgccgcccatacaagaccaggccgaggagccgggtcccaggcactcacggtccagggccagctgaccacgggcagccaccctgctgcatggcaggtgccctatgggagagttaggagccacagaggcctgagccagccccaggcagcatgaggatgttggcaggagcccaggagcccactaccagccaaagggtcttggcagagccccaagtgggcaggatccttggcctagcacctaggcctcgaggattcatctttggtcaatgctgggctgcctgcgtggagggctccagaaccttgccccatccagcccatacacccctcactggaggtgcaccctcctcggctcccaccccagtgagccccacactgggggcccctggaggctctgcccagtggaggcctcgcccagcccagggcacagccagtgcccccttgccccacaggaggcttgagcccacctgctcctccatgctccaccaggagccaacaaacacctgctgcctaattatctggagaatcctgtctccaccaagggctcatcttggtcctgcagctaattcaatccagcagccagagcaagctgagtccccagaggacactaatgagcaagtgaccggtggccggcctgctcccaccctggggacgcactctgagccaggtctgggcccagcactgccatacacctgcctcccatgcccatctgcctgcctgaccctgcccgctacctggtgcctagccctgcagggcccacatccactcccatgggctagcatccagacctaagccccagccctcccacactcccccaggaccctggatctgctgcatgcacaaggctgaccactgcctgtgagcccagagtgtcggccttgacagggcaggaggaagtacaagagcacatgctcagggtgcacgagccaggagcacagactcagtgcatgcaatgggacccctgggggtgcacacgataggcgtgcataccggaaacacacaataagagcccccagggctggtcagggctcaggcagagtccactgagcagtagagggttgctgggatgcgagcccctcccaggagccagggcccggctggagggtctgcatgccgctgcggcagaggaagatgtgtaggcacatccccatgtgttctcttgccctcagcatttgtaaaacatgatcaaccaggcaggcgagcggcctctgtccgagcagaatttattctgctgtgaaaagacacgtgtgggtcctgaggctcttgccggcttgttctcagcagccttggatcagcctcagtcagcagaacagcagctggacaggctcccattggagccatcccagggactgcccagcccttcacattagaaactgagctgggggcagcagctggcccacggcacataagcagtgcctgctaagaccacagagaagctcagccaggcagggccagtgggatccagcactccccaggggatgaggaatctaagaggcaggagaggatcctcctcagcctgggatgttcccattggaattcccccagccaaggccagagctccgtgtccgggggccagagtggaacccttgtcagagccgacaggccttggcctcctattctactggcacctggcaaactggcccaagggctggctgctgcttctgtaaaggatgtgctattggcagccagccacacctatgtgttcacgcattgtccatggctgctttcccgcaacaacagcagagctgagttgttatgacacactgtgtggcccacaaagctggaattatttagtatcacaccattcacacaaacagtttgccgacctggtttgtgagcaagccgagtgtgggtgctgccaccttcaccctcacaatggccccagcagttcactcagacccccactaatgaaaaggaaaccaagggtcagagaagaccacggtcctgctgaagtcacatagccaggtgaacagagcccagcaacctcagtgcaggctcagctctgtggagacctgggcaaggtcagcatctcacggaggcctagggtgaggggttctaggcaagaaagagactcagaaatactgaaatactctgcaggtcaaaacagaaatgatcatttttctaaagaggctgtcaggagtctcacagtcaaatatgcataaaataggacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtgctgaatgacacagtccggcttcggaggaaaggacttgggtggcacttcagaggagacaaatccagtgcaggtagttttgaagagggcagccgtttaactgaggtagggggtctctggggacagggcccctccatgccagtccacccaccttggaaccctgcagaggctgggccgaggcctctccctgcaccttgtatcagggactctggccaggtcacaccaaggtggcttatgacccattaacatcaagctgcctccctgggctggacagggcctggaaagaggtgacctgggcagatccgtgtcgatgtacttcccaggacatcaggattccagcctctgctaaagggatcttcacagttaataacaaagaaatattaaagatgagaacacttggtgcaggaaacaagagaggaaagggagtgcggtccctccttgcaaacaggatgccctggaccaccctccacggcctcaggcctggatgctcctgcagacccatagccaagattgtgaaggaaaagtaggctgtggaggcattttctgtccttgttatcatcattgtaaacatactcatcatcaccatcaccatcctcatcaccatcaccaccactatcaccaccataatcatcagcagcagcatcatcaccatcatcaccaccactatcatcattaccatcctcattaccatcactatcaccaccatcatcttcatcaccatcctcatcaccatcaccatcctcaacaccatcctcaacaccatcatcaccatcactatcatcatcaccatcaccatcctcaacaccatcatcaccatcactatcaccaccactatcatcctcatcaccatcctcatcaccatcaccagcctcaacaccatcatcaccaacactatcaccatcattatcatcatcaccatcctcatcaccctcaccatcctcatcaccatcatcactatcactatcaccaccatcatcatcaccactatccttatcaccatcatcatccccaggcgaccagagcagcaccatccttatcctcatcactatcaccatcaccatcaccatcatcaccatcctcatcctcatcaccatcatcccatcactatcatcaccatcctcatcacaatcactatcatcaccatcaccatcctcatcatcaccatcgtcctcatcaccatcaccgccatcagcatcctcatcactatcatcatcaccatcctcatccctgtcaccatcatcgtcttcatcatcatcaccgtcatcatcactatcatcacaccagctctgtgcaaggcccttagataaagggcagcctggggctgacctcacacaaggataggaagccccaggtgagcaatgggtcagtactgggtcgacaccagatatccctgggcagaggccctggcccaaggatggggaagggaagaggacaagggatggggagtaagaaatgagggcccctcgcctccctgggacagcccaaggtgcagcctttcctcattcctggaggtttcaggatatccctgtgctgcatcctcccattgtacggtgagggggtgactgccaacccactcctcagatgaggcactgactgaggcaagtgccttgctggccaccttgcaaggccaggagacagtgcacacaatctggactccaagatctctgcccacccccatcttcatcaccactatccttatcaccatcatcatccccaggcgaccagagcagaccctgagccccagggatgacacagcagggaggggcagccactctgggctccccagtcccccatggcacctcaacctcagcccaggaggctgccctcccagggatggctgaaagtgggccctggggtcttgcagccctgggctcagatgtagcctctgcaccccctcacagagtaggcagagaatctgccagccccctccaaatctgtccccacaccagtgatgtgaggacaatgagaggccagcacctacctccccccaggaccccaaagaaaccccacccaggcccccacccagcatcctgcctccccagaggcctgccaatgtgacctgggtcagcctcgtctcaggtgaggagtccagggaggcaaggtacagctcacagcgtcccagagccacacggacccctctgctccagcggtcttgcaaggccactctggcctggcctggcagtagccctgctttattgaggagatatggcaggcaggatcctggctgcatctgggctggaagagggggcagcagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacgaagccatgagcagcagtgcacgccggtaatcccagcactttgggagactgaggtgggaggactgcttgaggccaggagtttgagaccagcctgggtaacacagtaagaccctgtctctacaaaaaattaaaaagttagccgggtgtggtgatgcatgcctgtaatcccagctacttgggaggttgaggtggaaggattgcttgagcccagaagtttgaggctgcagtgagccatgatcatgccactgcactccagcctgggtgacagagtgagactttctccaaaaaaacacacaacaaagaagatgcactatggtattggcctccttcatagcacactagatgccaggaaacaacaacactgcaacagcttcatagctctgaggggaaactaatttcaacatggaattctagaccgaaacaatccagcttgaacatacttgtaaatacaggaagacttccggaatgattcttcaccatatcttctttagagagtgagtcaggcttatgtttcagccaaaatgaggtgcaaacccagaaagaggaaaacgtggggcccaggaagcattaactgaaatttcaacaggtggtaaagggaagttatggggcagcaggacaagtgcttggggtgaatctttatccagggaaaaaaatgagaccccaatagaagccctgatgtggggaagagtaagcccatgagggtggtggatgggtaaaaaacatcaactgtaagccccaaggaaaacaaaaggccatgaaagagaaggaaggtcacccatcccacggcaggattgagaagaacatttatgggacctgggttgggaaacactggctgtgaatttaactgatggcagcgagacagccatgctggggagtgtgctggaggagacagagctggagtagaagctgaggaaatgtggcggcaaccactggcaaagccagggaacagaggcgacagtggctgcctcccaggaggacgcggggcaggggcagattgagcccattctccagaccagcctccgaggctgggtgcaggtgttaactctgcaatatgttgttgaccgaatgttattattttttaaaacaactgcatatgtggcactaaaatctcagaaaacagataaataaaaagaaaaaaaagaaagtgtatcttccagaaggtggagacaaatgtaggttagaagcaggtgtctccaaggtgcaggaggagagcgagggacagtgagagctcaagagcacctggacatacagccccagggcagctggcatctggccagggaggatccacatgctgctttttggtcccctgctcggccaagggtggctgaggatacatctgggtctcccaggacactatgggctcttggccccagagactctgcaatccagacacccgaaggggcagcttctggcctaaaagcccaactctgtgcttgggccttccctgcaggccaggcagctgcttccctgaaccagcctcagagttcctgcctgcccacccagcccagccctcacactgtgatgaagccccacccctggattccccttacccctgcccgctcctgtcccctccttgtcacagatctgagccccccactccaggctggggcccctcaggagccgggggtaggggtgtgcggtcaacacccagcaggggtcgcctagcactggggtgggtgtgcagcccccagcctcctttctgaccgtgcacacgggcttctctcagctgctatgagagcccccaatgcgtctccacaaccaaaccgaggcacgcacgcagcggcgacgtgaataagtaattgctcttttattaacaagtgataaattattcctatatgattgtgtgtgataactcttccttatttgaaatcaatttgggatggaaactgttgtcggcttctcatccacgagggtgggaggcccaggtgccgctgcctcttggaaaacgaggtcagtgtatttcagctacttcctgaggctgatgcgccgccccactgcgcagggccagtggaagggggtcagctgccctccgggaggcggggcagtccggccttatttcctcagcatctctgtctgggacccacgccactgagcccagggcacagaggggtccctcaagtccaaggccacactgggcgtcaccacagggtcatcaggggtcagggggccatgcacaggccatactgcattcatccccccatgtaagccccaaagactgggcagcctgacctttcatcccacagaggacactccagcacccagctggtctcctggcctgcccgggccaccccacggtggcttctcaaacctgcaaaggcataagccattctcctaaaattgtcctgatgattttacaacagccctggccccatccccttttcttcctcccccagcctcacagaggagggttcagggactcagcctgttcagggcagcccctgggccaggcctcagcacctcttctgttaatgcatatttaaaaccttgcaacccaccgggcagccagccagccggtgcctccctcccaggccaggcctgcaggaagccatgccccgtcccgctcactcctccactggctgcttctccgaccccgatcatggctgcagcaggcctggaggcccggtcacccccaggcccagtcacatggccctactcaggcaccacctgtgcttcttggctgggtttctcatctgagaaatgggaaggctgggtctgggtgaggcacttctgtgggcccactcccacggtctccttgacacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatgtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccatgagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagccaggaagtgctctgctggcatcctacctggccctgacgccaggcctgaagccagcaccacccggggctctgttgctccaaggccattgcccctgctggcgtttgctcaaggagctccccctccagaatgccctgccctattcccagacacacttcctctggggggctcttctcccccagccccacccctgccacccctaaggaggctggccccttcccaatcccttcctcgtctgcaccactgccttgcccaaggtgtccatcctcagacccaatggggccaccatgggagcccggctgggtaatggcccataagctcctgcccatggagtactcaggcagggaggggcacaagcttggctgagcatgagtgacaggctgggtgggtctcaacctcaccctgggcctggggtagccccttgcaagtgaggatgttgaacacggtggacccccaggcagaaagtgagccacggggggctatgcaggactgcagccctcccctcccctcaattcactggtgagtagcctgctactcccctggctcccagggcagggccctcatcacctcgagacccagaagcagtgatggagaccgtcctgcaacatcaagctccctgtgatctgggggccaggggatcctgagtaccctgcctcctggagtgctctgcctgcagggggcagtagcagcaccttcaggtggggtggttggggtggcttcccggaggaagtgataactcagctaggagtggggcgtgggggtggtcctgacatgtaccaaggctgggggtcaagtgtgcactgtctctcagccaggagggtggaggcgctggaccaaggctgggggtcaagtgtgcaccgtctctcagccaggagggtagaggcactggaccactggggcctcaggtgtccaggtcacttgtccctggagtccctggctatgacagaggccctggtgggcagctcggggttggggacaggccaaggcataggggagggcacaaagggaggttggtgccccacccatcacccatcatccgcctcaggccaccccaggggaccggcctccgctccggcagcgggtgaagaatggactccattagggccgccatctgtctcagccatgacgggtcctcgcggtgacatccgggaggtatgtagatggaatatctttatggggagagtttttcttttgccagttttcaaataggaagccagacacttgtcacacctgtccctgtgtcagcctctgcctgacataaattggggccgaggcagggagatgaaagacagcctggaggcagccgggtgcgcagggcccatgtgtcaggccgagggagcaccagagctgcaggcagcctcctgctggggccaaggagagctcgccccgcagtccacctccgcagcctctgcccctccctccactcccctctggacccacaagttcttcacctgccctcccccaacccagagccctccaagcatctcacccgggcagtggcctgtcctgcagccactgggcttctgttaggggacactggagcctcctcagcccccaggccagcagctccagctcctcttccagacctggggccagtgtggctttcatgagcggtcaatgtgggaggctcagagtcctcaacctcacccccgctgccactcctagggaccttgtgggcttcagcatgtttccctggaatctgggggacttgggggtagagcatgtcaagaacctcaaggtccctgccgcccagcatgggactatcttagaactgatgccaggaagaatttgctaagagaatgaagggagaagcaagtgacccctgtgggcctcccctgcatcggggactggaccagggcccactgggagtgcatcttggtgcctgaaactgcaccaaggatgaggaggggaggaccctccccaggggacacttggggttcacctggcaggccacactcaagtccacagtcccccatggccccagcgggtggggcaggggacgcacccagctgagggaactgtggcagtcctgctgttgtctcacgtggccctagggggctcatctgtagcccccacgggagccccaagaagccaatccctgctgggctcatgggctaccacctcatacagccccatccctcgggaggccctgaggagaccctggggctgggcagggcgtgaccggccagctccatgcttcctgacaagggggcctggatgtccagggagagccaggagggaagcggagactcaagtggagagtgtgtgggagggaacgttgctgggctccacaaaggagggggcaccagggctgactcccaggttcctggtggcatgcgtggaggcaggtggggccaggagcaccagcgcagcacatcctgcgtgaccttgggccagctcctcagccctccctcgacagccgtgctggtagctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcgccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacatgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgctccagcttcacgatagccacgtgcggacagggaggctcagagggtaggtggctccccgggggaaacagagcaacccttgtgcagccggctgggccaactgatctgcacctaacagccagtcttgaaggccaccaaccctggggtctcccggagctgacccagggacagaagggcaccaggcactgcccacaaaggtgcaactgatcctcctcaccggcgcctgggccctccctccctgccagtgtggctgtcccacccttcatggctttctgcatcctcaagctaggcctgggctcttcaagtggagaggggtaggcagacacaggtgccaggcactgggaactagggacgggggcttccctggtgaggatggaaaagaaggttcctacatgagaccctctagcccaggccctgagaacgaaggggccaaagcttcacctaggggcagccatgggggagtttaggcaggcagtgcctggctggaaacatgtcttagggaagcacttgaatcccggggtggggaacaagatggtaggcagggagccggggccggctgtggccacaggccggggacagaggccaggtctgaggatggccctcagtgaggagtaaaggggatggaccgggagacagggtgcaggtttgacactgattttgcctttggggatgggtcgagggaagaggctgagactctgggcttggacgttgggtacggaggatgtgacactagcagacaggctggatctggaggcccaaggtgtgtagtgtggggagctgtgtgtgcaggagagatgcagggcactagggagcctgaacccctgctccagtgcacaggccgggcacacggcagggaggaggcagtcaccattccctcacttgccgggacctgggaggcagggcagagtgggtgatgggccaggctggggccttggaatgacatctggcatgtggcagcggaggggggacatgtaactggggactgtggactcccagctggaatccacctccaccttccacatccacgcactgcattttggtctttactgagcacctgctgtgtgcaggggctgctctagcccctgggaccaccaagggccagccctccacaaccccagacctgcactcagcccccacccacttcctccagagccccacaccccacacactgaggactctaggcattttcccactcttgaagacactgagctgggaacaccacctctggctaccagccgtggactgcagagaggcctacggtgaccaggaagggtggagctgcccaaggtcacacagcaagccagcactgcacaagcttacccatggctgcccagccttggggaatgggggacttctggcatgtccccgagctgggccctggcagaaggcaaataaaggcaacatctcaacaaggttgtgatagccggggatccaggcaagcaagggacaatccaggaaggctcccaggaggaggtgaggggcctggagcccaccctggcctgagcccctccttggcactccagcctgcctagccctgcccccttccttgacgggcccctcacccagcctcagccttggcctgacatttcccgtgacatttgctgcaaagaaatagagtcataaatccaaaggttaaatttgcacatcgcctcaaattgctgggagaagcagtggtccctccacccactgggcgccccgtgggtgcggggtttgtgtggcagggtctacccatcccagggcccttgctggaggcccacaggtctcctcctctggtcctccggggcacttcaaccactgtttcccaaaacaggttcctgggcacaccaggccctgaggtacatcgcataggggtgcctctcagagaaggtgctgcccacccctctccaaaacagggcccaagacgccctgcgggaaaggagcaccatcagcaccatttattccagcaggtcccacatttgaccacaaagcccttatgtgatacccccaacattccaaagaatttcaactccatggaccgtgacccgtgacagccagctaagaatgccagggtgctgactggagagccaagaggcacccgggggcccagggcaggctgctctgagtgaggctgggtcagcacccgacacctcactcccagatcagcccagctccatgtgccagggccctgaatggggctttccacctgccaggcctgtgtagacctacatggggaccctggcctgtgcccactcagcccctcctaaggccactctcgaggtgtgccaactgccctgcctttcttctccacctcctggtctggctgctgtgggttgcctccatcggacaggacacagctgcggaacagtgtcagcatcaccccatgccccgctgccctgctgccccgcagaagaggccccgcaggccatagcaggcaagaccagaggctgtatgaaagaggcaggggagaggtggccccaaggcacccactgcacaaatggctgcccagactctactcactcaccatcacctacccggccagcccacggttgtcaaagcctcagtgggctaggaggggcaggatctggccctgctgccgagtcccctgaaatcagcccaagcatcgggggagaggcacgtgaccagaccccagacctggtgggtgccagctgaggacatggtggggtgggtgtgcagagctgcatctcccagtgtccagctccacggctgcaggcagtgcaggaggccggtgcaggtttggataaataaatgatggtgcattctcaggaagggattccacacacaccagaaaacccatgatgcacaagaatagttcccgatgtgcaaaatgtttaaaatacagcgataaaagaagaaacggcagcacagaacacctggtgtgggggagcccagctgggccccagggacagtgcagggagatttgtggggtggggcagcatgcccgccgctccgatcgggcttccctgggccactctgtgacctcctatcctttaaagcatttaatcctagagatgcccgatgccaaggatcacaccccttgatttgcctggctcagaagagaatctgacaggctaggaacgaacgagtgaatgaatgaacaaatgagaaagtgaatggatggttggggcaaatgcagcatctgggatctggctttgaggagggtgcctgtgaccttggcctgggtgcagccagaccgcagagcagggacactgaggggtgcagagagggacccgagagggcatctgcacagctgcagaggcagcaggcggccaagccagctcccgcagaccctgaggcccaggccctgggtggctgcagagggtcaggcagaccagcctgggggtcagaggtcaggctcaccagaatgggggcgggacggcatgaacctcattgatcagatagtagccaagtgtcaggagccctcactaaccctgtgccagggccgggcggggcgcctggctcacacacgcatttgttcatttccaggtcatcctgaaactccccgtgtgcttcctgctcttgacccctttcccaggtgcacagaccaaggctcccggtgagaggttccgggccacaggcccaggacagcaggagggctcctctgcctcccgcccgtcctgtcctcaccagctggaccctcctggtgttgcaccggctgcacagggccgtccgtgccacaaagcatgaattcaaggctggggcagggacgaggagagggcaatgctacaaggctgcactgttcctgggcagagggagggggagagcacggtcccacacaccctggccctcacagcctgcctgtcactcacagcaacagcaaacaaaccctggcccctccacaggctgtgggccagttcccagcctcccaggacagcaggaccttcccccaccttccagggccccagcccctgtaggggtgtcctccatggaccctccacaagccctctggctttcagagacgtgctgggccaggccctccctcagcctctcccctgcttctcactccatgcaaacctacgtttctgccagtcccagcagaaggaccctggcacggggaaactgaggctcaggggttccacagacccccaggtgaggaacagggggagggcagggagggagtgaaggtactatgggagggtctcccaagctgggcagcatccctgccctgtcccctctccactcacctgtggcccgagttgcctgactaggggcttttattgtcccttctgcacatggatggggtgaggggccagctggcagtgcaaaggtcccaggaggactctgctgagtgggggtgtggggaggtgttgtgggcattctgaggcagaagcaccagagtcagaactccacagggaaagccgggccaattccgcccagcctcagcctggaagtgccccgataatccctgaccactggcccatggtgcaggtgaggaagactgaggcagagaggcgacctgtcacacccaaggtcacaccgccagcaggtggctgagccaggacccaaatccaggtcacggttctgccacggcaggccctgcacgtgcccctctgccaggtggcgtctaggtgctgatggccacccattcccacccccggcatgggagctcacttcctcctcacctcagtagagaagaacagggaacagtaccccctttatagatgggaagactgaggcttagaaaaagagactggccagccccactgcttcagctgcccctctgctagtatgtttcaccctcacacaacctacaaggataacctgctggtccccactctatagatgagcctctggtggtggccaggggagcaggaggtgtggcctgccaatccaagccccagcccagggcccttgccacagtgctagtgggccacccttgcccatcatgcagcatggcatccatctgctcagcaccctacacaacaccggaggtaggggagcccaccacagaacccctcaccaagaaggtcctcaccatggagaaactgaggcactggaggcggggcctctgcagtcacgctgggtcacgtgctccagtcagccaagctgcagcggccaccaagggtgcccagggtctggcctgttggtcacagtgttgacctcatggcctgaaatgggtcttccctgcccagacaggttccagcccaccatcatctatctgcctcagccctggtgggtagggagtggctgggagaccctgcccctcacaccctgggctttgcggtattcaacgagcccccaacacacattccagggcctctgctccagattaggccacagcctgtctaggcacacaaggggcacccacaccctggaggcaaagagacatgcctatgtgcccgcaggcacacatgatcacgcgcacagacacacgtgcagatgcataccaagttacacacacgcacacaagcccgaggcggggacccccaggacacggaggcaggcaggcagaggtggggcccaggatgtcttgcccctgtctgtgggcctggcctccccactcaacagacgagcatgtgggtgcgggagtggttattgcgaaaggggccccagcatgtgccacccgtggagaccacagcaggcatgccgcgtgcatgcatgtgtggccgtgggtgtgcaggcgggggcgaggacacagatatgcaccctcagagtccgtgtgtgcacccagtgtttgtgcatgtgcacactggggcggcgttggcttgcatgtgcaccagaggtgtgcaagtgtgcagtccgtgtagacaagtgcacgtgcaaggaaacgtgtgtgcagcctgcggcaccatggacatcagcagggcagcctgggtgggcacctggggagcaccctccaggcggggcatgcccaactcacatggagcccaccctcccttgcccgcaccgcgggacctcacagccggtggggcgggggagtcccacgagggctgctagggaggggttgctgattgccccaccgcccctgattcccccagccaagcctctcaatgtccctcgggctgcagatggtgggcgttgctgcctcctctcaccgcccgccctggaggcagcgctgggacaaccctgtcccccacgccctctactgccgccaacgcccccattcatcccactgtggactgacctcggagaaacgggaggttctgagcccagaccgtgaggctggggtggaggcggcccgacacccccacccaccctcggtacccacgtttctgcaaaaacccgctcgttaaccccttggtggccggggcgctccgaggccgggccccgcccttccagcccacggcccccgccctcgacttggcccagcatcggggaccctcggaccgccaccctcggccctgccgaagccgtcaactttcccgggaagcggcaacttttcctgccgcctccggctccgccctcccggggccggggcgccagcggccccagcctggcgcggcactgcggtggctttccctgccgcccggctacgcttccctcgcctcggcagcccgggacgggccctgcggctccggggagggggcgagccgcccccctccgcgccccgccgccggccgggctcgggtgcagcgcggacactcacctccagcggacgccctcttcatcgtaggggttgggcggggcgcgtcggggactgaaagtcgtttcggggcgggcgcccgtctccccgcggccgggtccgcatccaggcgccgccgctacggcccggccccggcccggccgcgggacgaggctcggcgcgctccgctccgcccggctctggctgggctcgggccgcgggtgcgcagggcgcgcagggcgcacagggcgagggcggcggcggcgcgggggttggggcgtgggcggcgcggcgggccggggcgcgcaggccgggccgcaggaggcgctcagcccgcccggtgcaccggcgccgcgcggtcccagacaaaggcggcgcattcctgaagaggcggcggcccctgcaggcggcggaggggatggcggcccgggccggagccggccggggacgcgggcccgagggtgtggcggcctaggctggcccggtccccaagcgggcaagggctttgtcccgaggcctaggaatggcctctgcctgacccactcccttcctggcctcacgaaacccatgaatcccccgccccctgcacagaagccccttgctgcagcacgatcgcccccatttttcagtaagaaacaggctcagggcttaagagagttctgggggccctcctgggcctttgtggccctctctgcaccatcctagagaagggacctaggcctgatgttacccgtaaccctgcaggggtcccccacctcttcccttctgcggaatgggggctccaaacccagaagacgctctccgaggtcacctgcttagtatccccccactctaccaagccagccccccacgggcggtgtgaggcatggggccagagaatccagtgacgcccctgcacacaccacacaggggtgcaggtgtcccttctcaatcttctgctcggggcacctaccgggcctcaccgatgagctcctaagtgcatcccggggtcttcagacaactgccaggctgcccctgcacctggagaagtgctgggagtcagctcagccgggctgggtcctccccaggcccaccctgcatgagaggaccatgcagatgagggtcttgcaggcccacctggtgtcagtctgtaggaccctgactcaaggacggagtgggccagcctgatgccttgatggcccccctcagagcccaggtccactgatatgaagcagagagacctggtgactgggcacccctgtgccctctgcctgcccctggccatggaggtggccctgagggagatgagcagggcgcagggccggtgacctgcctgccttgtgcagaggaagtgaggacctcccagagccctggtgctcccatctgatcccagtggcaggcagcttcgcagggtggagccatgctgggtgggccctctgcctggtgtggaggctgcactgcccacatgcctctggctgccgctctgtggccctcatcactttggcctgctttatccctatcacccttgtcccagcctaggcttatgagggcattgtggagtgcatgccattcccagccacacagaaggtgaggtggggcccagacacccccagccactctgtcccctggcctcctgaaggggtgggctgtgcacacactgccacctccccagagggtgctggctgccgagtgccaccagctcagcccctgaggtggctcaacaggtcctcccagagccacaccaagacgtcatcacccattgcacagatagggaacctcaggcgaagctcacagagccagtgggaggctgaggcctgacccccagacaagcattcttctccagggtccctgcacacagcagcccccaggctaggaactgagctctctccacagggatgtatcagaccctagatgagtcacgtggcactgaccatcagtctgaggacagcgctggggtggaccaggctccagtctcgggctgctctgtgcttgcagaaaggccttgagaggacacttgcttgcttactccgcaggcgtctcttcaattaccagtgacccagagcagcccactatagctgaagattgtgaccccacaccctatctcataggtttaaagcccctcccacccctcctgccgcagccgaagtgaccattctggggcatgggatgggcatggggtgaaatggggagcaggggtggccctggaggcttctggcaccagcaccctctccagccaccaacctggctgttcccggttgctctgcgctgggacctgggcctccacctccccacaggtctctgcatgggagcagggctgaggcctgcagagggagcgctgggggatgggctggtttcctgtgtccgccacctcggtcagcacgttggccagcaccctccccactggaagctgggcccactcctgggtgctagctgggatggttaggcgtcggccagcgctgatagggagttatgggggtgcagaggcagagttgagcagggctaggcagccggtgggtctgctaccagcaaggcacagcccacttctcaggctgcgcatgtgggagggtttggtaagccacatttttcagggtgtagccgggtgaggggtagcatggggagtggtgtactctttgggcaggcgaccacggagccatcaccccccagggcccaacgggcaagaaggggagcagctgacggctggtgaggggctagcagggagggcttgacaagggctggagcccctggtcaaggggcacaaccagttctatcgggtcaccttgtgggaggagccagggaccctgtgggcagagcctggccgtctgctgcccggagtctacaccagtcagttcctaggaagccccatcaggggtgctgggaggacaggccatctgtgcccagctgatgcaagctcccaggctttctggacacgtggccctggggatcaggagtgagctggagactgcagacagctgtgccctcagggccacacagacctgtcacaccctgcctggactgggtcagcagggccacacgggcatctgcccgaatcgttccccacctcacacccaccatgtggggcacattctttgccagcttccccagcccaccacccctctacagtgaggccaggggctgtctcacctcccacccacacccacacccaaaatgtggggctcagcctccacgaccagcatgccggtcatgagggccctgcccagctgtgtgacctcagcccagtcccttggcctcgctgagcttgcacagcatgtggacgaggcagacgctaatgcctcaggtcctggtcagctggtcaccatccctcctttgttcacctcgcctgtcccctgagaggatcatgcagggttttcactcaaaactccaggactgcccatagaagccagcttgagatgaggggaactttcgcggtggcctgtcttgggctgacagggacacggttcagcctccttggaaggtcactgcttcccagggcttgggaagactcatctcctgcctggagagataggcgtgccatggctttccttggcatgcctgtgcggtactcacggacatccaggccctcagtgtctcctggggagggatggggcagcaaggaaactgggtctttgctccacacattctgggccactccaggccaatgcaaggagagaccaagaaggaagctagaaggtcatgtggcaagcacatgcctgctgcccaagtgtgtcaatgtgactgaccttccctgcactctgagtgggcggctggggatgtggtcccagtgccagggagctggggggtgttggcctgccatctgctctcaccatggagggcggctgcatgcccaaggcctaagaggactctgtgccaggcctgctgagtgagtcatcccattcaatcctacagtgtagacactactaccactacccattttccagaccagagaaggaggtctggggagcttaggtggacccacatcttggcagcccctttctgccctctctttgtccacagcctccgcctcctccagaagcctctcaccatcccccatccccggggctgcagagggtgtcctggccttcccctatcagctctgcacccctgaggactcccatccctaggagtccctctgcccaactttggtgcatgttaagccataattaatctgcttcctcatctcttattcatcaaagccacagcagcagcaaagggggctggcacaaggaagggaccgacaaccaaaccctggcagtggccccaagaatcccactgggcctgcccatctccaaatgcctctgacccttcactagcgagggcctcctcccacagaatggcatcctggattgtgccacactaggcaggccccctgacggaccatgcgcacctcccaccacctggaggctgctggggaccgtcaatgggacgtatgcattgcacagtgatggcccttacctctgcgtcccccagccctggactggatcccttgtggcccatctccaggatgggagcctgaacggagatgaaaggacactcggccaagtgggacatgccaggctggcacctggaccctggtccgccactcttcctggtgcctagaggaaggggtgagtccccagggctcctggaccttgagatgagcctcgggccacttgtgtttgccagcagatgggctcagggtcttctctcagtgggcacaaccgagttggtggcctctctctggggaggccggctggtgggggctggggagtaggcggcttctggtccctgaaggcccaaatctggtgcaggggcagagctccggaaggcgggggtccctgggctgtgcccaaggcatccgctgtggcttcacgcccctcccccgcccctgcagggagtgtggatccttctagagccacccacctggcagtgacagctaaattgggagccgctgttcacaccaggagcccagcgggcagtcaaaaccgggtcgggggggaggggcacccgctgaaaacacccacaagctcccagtggggcagggaaggcagggaaggcatggtgatagctgtcagcaggagtgggtggggagtggaaggcagggtagaccgccaaacccatcttggggccatagtgagatggcccctgggatgcttcggctggccagtgcccagccttgctcttgtaggagctccctgggcccctgggttccccactctgggccaccacaatccatgcagcatgcaggtttgttccgtttcccagatggagaggctgagggcttaccacagggttccgtcaaggacgcaaaagggccagcctgactctgagctcagtagccccaccctccacagcctcccttgccgccttcatctgctcacttcctcagtcactcaacaaacactctgggaggcagactgtaacaccctgcatacctctgctggacccccattccacatatccccactggttacaggtggggaaactgagtgcctgggaggcgggccttggcctgagtcccccagtcagtgattccaggataaagggcatagccatgccatttggtcacttgaagcccacaggggtgactgggaagagcccacctagcaccccacattctgctagggtgactcagaccaagtccttggggctctgccccccagccagtggctctgcctctgagagccatgggacagggagctgtgcagggtggggccagcagagcctgtgcccctgcctgagctagtcgtgatggggcctgccctgaccccttcccaggctcatgggtgcggagcagggcggggccttacagtgagatgggggcctctgtgggcagtcctggaggccaggccctggggctgggactcactggcacagggcctaagtttcctcctgtgtccgcaggccttattgcctgcaagggaggtggaggggcacaggggcggtgcccagcgtgaggagggggctctgaggaggctgcagcagccggcaggcctctgagactgggatatttttagccaggattcctgctgacggtccaggctggccggggtttgctgccagccttagaggcgcttctcctagtctgtgtccggacatctggggtctgctggccccacccaccctctgctcaatgcccccgccccactggcccatccagccaggcgaggggctcccaggaggccggccatggtgggagcagagcctggggccctcggggtgtggctgagaagaggccacatgggctgctgggggctgcctgtgtcctgggtctccagctcccagctgccactcttagccgacccgcttaaggggcaggtttctggaggctccggttcatgcccaggctcgagttctgaactgagcattctcagtccgctgcctgctgcctgctggaacggatggctcagcagagcggccacagcttggctccctcctgggcactcctgcctgcccttgccgcttaggtgctctggtcatcaggcctctctggctggctctaccaaggtgcatgtgtgcagggcctgggcttgcagggccttgtggctcagccaggaccacctcccttcccatgggcaagtgaggacatccagaaagagggtcctctgcctcggccactcccttgggacacccctccaccccaaggcctctcgtggaaacagagtccagcactcagcgtcatgcctatgcactccaccggcaggactggctgagtcccgaggagccaggccctggggcacaggccaatcggatggaacccagatgaaagcccagtgctgggacccacggcccattctctggcctggctgaagcctgatggcttgttccttgaatgaatcaggaggcccatccagagcaattgtgaagttcacatgaaagaatgaacgtacggagagagatgggccatgtcgcatcctgaaacgccttatattctaagaccatgataattaacacagaccctggacagtcacacgatgggaaagagtccagaaagaggctcaaatgcaaatatgagaagaggcaggtcaaatccaagaggagagatggaatattcaacaaataatcccacatatacaatcaacacttggccttaagacaacggaattgacatatggaggaaacatttggattcctacctcactccttgacgctaaaacaagttccaagtggaactaagatttaaaaagtaaaaatgaaaccataaaactcctagaagaaagcatggatggcaaaaaaccaatcttgagtcactctaagaattatacaaaacccagaagccatgaagtaaaagatgggtatattcaacctcgtgaaaataaaaggcagatgcatggagagaaaaaaaccaccataaaatgataaccaacaaagggtaaaaacatcggcaactcagttcacaaagggccgtttttggttctcaatacaaatcagtaagaaaaagagcaacagcccaagagaaaaatgggcaaaggcatgaaaggaacctcccatcaccccctgctgaccttcactcagagtgagaaacatgcggatctaagctgcagtgagatgctgcccctcacccacagggatggcagccgcatcaggctgggggttccctaggggggctgcttaggggctcccacaggtctggctgttggagggcagggagaggcctgcgggtctggtggggccggggtgaggcactcacagatatgtctagtgggggtgaggagggggaccgcctgcaggtacagctgggggtgtcaggtcgctggggatggggtggaaggagaggatacccattcaaaacaggaaatatatatattttaaagtaaaacaggctaagtgcagtgactcacacctgtgatcccagcagagcggggagaatcccttgaggctagaagttcgggactagcctggggaacatagtgagtcccagtctctataaaaattaaaaaataaaattatctggctgttacgatgcacgcctgtagtctccgctacttgggagctgaggcgggaggatcacgttagcccaggagttcgaggctgcagtgagccatgattgtgccactgcacttcagcctgggcaacagagcaagaccctctagaaaaataattaaaaaaaaataaaaataaatataaaataaaataaaaaccagctgacatccatcctctccttgccaccactgacatggccgtgggccgagttctcatggccatcccaccgcgagtccccaagcgctcctgatgcctgctcacccttcttgtctttgttagcgccccgttagcagaggcctgcttaacttgtctctggtcttgcttctcaggagccgtgtcacattcaacagtggcagcacagaggccctgctcagccccagtccctcaccctaggcctccactgccagatgtggtcctggtggtcctgcggactcaagctgtccccccctgcccaaccttcacaggccaccagcaagtcccaggcctcccacaggcatggctctgggcagtatctttaccttcccagcctcagtttccctgatggtgaaacagggtgagatctacttcctagcagagaatccgggggaatggaggccgtgggaggaagaggacttgaggaaaggagcattcctgaggggtcccagagcgggctggggctgacaggactgagtttgcagggcctggggacattccctggggaggtgctaagatgccggtcagctagagcagcggggagtgatccaggatggctgcccggatgaggggctgggtcgctggtccctgagtgccaaggtggtctgtccatgtctgcaggaacacacccaccctgctgcctccaggaggggtgctggacaggcctgagctccaggatcataggaggcaagagccactctcaccaaagaacagcaagtgtgcctcccctgccagcaatctgtccggtccagcccctgcccagctatctggggaaaaggccaccttttcagtggaggctgagctcagggcaggaagaggttgagaggggagaaatggagtgagaactggaaggtgagaggtgtgagtgagaggtaggggtgtgaattgggggtgagatgtggtaggtgagagcggcaggtgagaggtagggatgagaggtgggggtgagaagtggaggtgggcagtcatggtgatagcttgtggggtgagaagtggagggtgagaattggggtgggagttggggtgtcacctcccaaaccctctcaccctcagattaagaagcccctcctatgggccctggaggaacaggcctttgacccaccccaaccccactggtgtcttgggcagggagatctcgaggtgggggcctcagctccccgtaggaccgtctagccctggaccacctgaccacagctacagtgggacaaggcccctgttgcctgtctgctgggggccgagcgtggtatggaggagccagcagcccccgccttcatcacagaggaggaatccgaggcccaggagggtgtctctggcacccaacacgtgagaccctttgaaaatcccccgagtgtgtggggggctgggatgaacatctgggggcggcagcagcaggtggcccacctggccaaacacactcctgtgtccccttgtttttggcaatttcaatgaccaaaatcagatcctggtatggagaaaaagacatcggtaaggacgaaggaaatgtgaacactgcatggacgatggctgataatagtgtgccgctattggctcagcaactctaacctaccaatgccagatgctcacaacggtgaaactggtgtgtggtagatgcgatctctctgtactgtcttctcaatttttcagcaaagataaaactgttctaaagttgaaaagtttattaaaaaaaaaaaaagaaaaaagacgggcttattagcaaaaatctgagatagaaccaagcagtagggcccagcccaccccccgctcagggcgcaccagcagtacccctctctcagggacatggccaggcctgggccactccgaagagctcttcctggtgctggggggcctggtgggtttattccacctgtcagtctcactgcaaagtgtggcagtggagtctgagttaggctgactcttaccctgccaaggacacccctgcactcaggacccagccccggcccccttgccctgtgggctggaggcgaccctgtgtgcagatggcagatggaggggcatggtgctgttgctctcaggtcaggggcagcagcctcagccctgaccagccctctcctgcgtggttgtggttgggtctcctggtctctggcctcctttccattccaacctgtagaaaacagtgtggtgggggatgctcggcctgcagatcagacaggccggggtcaaagccccgaactaccacctgaactagtcctggccgagtggcgctgatgctctaggccgagggcccccttgacagaacagccatcatctagctccgccgcagggtaggggaggtggcagtgtgggccgcagccctcggctgaagcgggggccaagcggggctctgcctggtgcagggggtttcctctatggggcaggggctcccaaattagccctggtgacatctggagctcacctctgggggctctgggggctgagagagcaggcggggcccagttctatcaatcatctgccttgttcctgggggatcgcggtcagtcccagcctccccacaagtcctggggcggggcaggcctgctggaaacccaagatgcagagaagagcgccaagcacctgagacagggctctgagcacggaaggcaaggacgcctccctcagcctcagctggggagccagtggccctgcatgcactttctcccgtctggggagcctgagccctgacccagtcccgaggcccatgtgtgcacaaaagccccctgctttctcacccaggacactggcgatcagtgggtaggcgagccggagcccagctgctgcgctcccttccctgccaggaccgggccagctgcatcctcatgcctgggtttcagggcttctcgggggatgtgatggcactgcctgaggatgtgggatccttccactgaaaagggccacacggctgtccccagcacccttccagaagggacaacccactcctgggaggtcttaatgtagacatcgaggtcccccgagcttcctccatggcctggccacttcacaaccatatttctttatgttccacgcgccttgcctgctccacggccaggaccagggccaccatctttgcagccggtgaagggacagctgccgtgggctgggctgctgaggcaggacaggggtccgggccagggaggggtggatggaggccaaggatgggccccttggagacagccttggggtgcagccggctctgccacctctccctggcttccttccctccaacctgtgactcctgggaagtccctgatgggccagccacttggggccgggaagtaactgtggtgtgtggtggtcaccctcaccagagttcatggggtggagcaagggggaagaatctcccccaaaatcaggtgtcttgttcccaggcccagcacagagacctggcccccagacatctctggacatttgttaagagtggacaactgcttccattacacaggagaggaaaccgaggctctaaggggtcccagacttgcctggctgccacagtgagcaggcaacaaataccaagtggctgccgcaatggggtaggtgggaggcagtggctgaaccagaaagtgctgctgtcgattctgctggttgcatgagtcttaggagatcatcaaagggcagattgtggggagataaaaagtatgagtggggaacaggattggggggagcagaagagcctcaaagaccctgcgacattctcaacgtctcgatggtgactcagagatagctccaacccgcatggcgggcagagtgcggaggggacggctttgtggctggattagtcatcccggtgcagctcaccccaaatcccggcttccagccctgggccgtccatgctgggatggaggaagggcagcctctccgcagggccacgtcctggagcctgataacctggccagcacactgtgcaaatggtgcatgagacagggagttggctctgtgttccccacggtggccaagggaccagctgtgcctcagtttcccttattctatcaaactttgaagaaggtcccgtaaaagcgcatctgtttccagggtaggggccagagtcagccacccacaccagagtgagaattggtgggtgccctagccctggcaggatctggcattttgctggacggagagaggaggcagcacccactggggctcgggcaaccatcccggctacccccgccccggcccgccaggagaggagggaagccttgaagtgccaggcctttgaatcgcccatctccatggcaacgcgtgggcacaaagggccgggccggcgagcaggcggcggctgcgcaagctggaaggaggaagggaatcttttatttatggggagggagagtcggggagccaggctgcgcccacgctcagggccaggccgcagtcttgaggctgggccccctgccccatagccagggcctctgagcagcacctgcccacacacccctgaccctccgtgcctggctgggtggacggagcatgggcaaatggagggcagaatggagtgagtgtccagcatgcacccaacctggagatcggcccagagggtccctgggagcctgccatcctccataccccagtctctgtgatgcgggcacccgggcagataccatgctgagagccagctgggcctgcagtgaggaaacgtagcccaaagcagactgcagagctggaactcaggtggggctgctgccataggctctgaagacagcgcaggagaccgggaggggtcaccagtgccaaggccctgaggcaagccagagctgggagcatctgaggatgggcattagcgtggggctccagggtacagccggtccactgcaggcagcctggcctccccagagacccagccacggctcctcaccttggacagggggccctgggccttgggcatcaaatgacctgcttgccgcggtggaggctgccataccaggacgccggcccacggcctccagcggcccgtccccaccttcccaagcccctcccctcatggctcacaccctgttccctgagcccccaaacatgggaaatggcacctgttgtgccccagcgggggaattctgaccccagaccctggggccagtgcagaaaccaccactgtatcagattttatttcatctaaaaaatatctgagccagattgaaagcagcggggaaagggtcccatggctgcttcccccagccccaccctccacaggccctgggccctcccagcccccatttcctttccttgagaaagtctaaagtggggcaatattttgtgaaattggaggcaccacgttggaaattccaaacccgtgtgtacgatgagctgcacgcgcgttttgaacctgccctggttttgagctgagggaagcggagggtgcaggagttgcccactccagaggccctgggtgtgcatgaggagccctgaggctgggccgagagccgcttgtgggaggcactgtgccccctgcccccgagatcagggcctgggtgcccaggacactacagaccttttggggatcctgggggttgggaagcctagagctggaacccacaggccagagtctgagctttcatcccccacccccgaagacgctcccccagccactgcctgcgcatcgggggagacaagctccccccacgcccaccttgcctccagcagggctgttcctcccctcatctgctggcatcagttttttctttaactgagccccatgctggggaagggagagctccaggggaccaggcagcagagaggggaggagagaagccatcaaacaggccgggggctgggaggccatgcactcagcatagagccccacatggcagcagggggctggatggccggcttagagcccattctctcctggacactgttctggaatggcccctggcccctccgttccaaagatgggaccctccggtccccggggacccgggatgatgtcccccaaaccacctctcttcccagacttcatcaatggcaatgaatggtgcatcctggctggggccgccgcccctcactgtgagacttcagcccagacgagcgcccagcccctcctggggtctcagatagtcagaaagaaaggctcacggctgccatgcacttccacaggactttgtggttcctcctgcacccccggtgatgctttcatccctctccagcaccattccagaggccagaaaaccatgatgtttggggtcaaacagctgggagaggcagttggaactcaggccaggcctgtctgactggacagtgcagagactgggaccatgctcccctacaagtgctgtcagtgcaccctcgatgccccccagagcttgccatgccccgacagtcccttcatggccaaagtgttccctggcacaggataccctggggtgccatgtctgcaagagctcacacccttctctccccagctgctgctaactgctgccagaggtgggagtgtggagggctcggggcctcttcaccctccctgcaccaactcagctccagaacattcccagcagtgagaagagggtggccactgtgctgcagccccaagggatgggcaaggccatgccagctggagtcatccatgtccccttggacatggtggcctcattcagagggcagcatggaggaaggtgcaatgagggtggctaccagagacagtggagatgaggcagtcaggaagcccagggacaggactggaggggacacacggccagcctgggacagggcatgaggcctttgttctgcgtgctgtggcatacggtgttggctctggccctggcccatcttttgttagtggtaggagggtgctcctttaatcagccaactctttgtttcaaattgcccctgtccttgaaaacactgcttcagggaagcgtgagacaaagccagttcagtggggtgcctacctggccagcagccctcatccgcaggggctgctcctggggcacgtgccagaatcagacagtcccaccgtcatgcaggtgctggggccttcagtcagcaggaccaggcagcccatgtcctggggacccttggggaggtgtgggcatttgctgagttgggctgtcatttgctagacaggcgcttggcgaaggggcccttttgtgcatggatgccctgggcaggtgtcagtcctgagtcctggagaggaaggcaagctttggagttgatgctgggtcctaggagggagcgtgtggtttcgccagcttctcaaaagtcacctgagaccctgccaagggacctccagacattcggtgcaggctcctggaggctggacagagggcaccaaagggcgacgggccccgaggacagaggtgtgcagccaggtggggccatggccaggctgggacctgctggagctcttgtgtgtgagcctggaggagctgccaggctgggggagatcggggctggggctgggggcggggctgggcgtcagcagggtctgcagctcccatcttcccagcttatagacctgaatatccaggttgagaataaaccattctcccagggcaccatagcctccaggaagcacctcctccttccaccatccgcctttcaggaggggcctccctggggggctgtctctgggactgcagaggctgcttggtgtatctggggctctgacatgagtgagattgttccggggcctgtgctgcccagcctcttccccaacagcttcctctggaggcaaggggcttggcaggagctgcagggagccaattatccctgaggcaagctggctgcagataattgggaagacaggcttttcaccagcagccaagctctggggcgcactcgccacaccaggacttgggacttgaggatccagaggtctgccaaaccccacgcctgattgggagccccatgtgctgccatctaccaggggaggtggcattttcttggcaactgaggggggaagccaggtgctgaggtgtggcccacgggacgcctcgcctggggacctcccagcccttctcctctgcctcctaggggcctcctctccttacacatgaaaacctccaatgtctagcccagggctccagattaggggtcagtgccgcccccagcccaacttcctctgggaagtgtggggttctccccggggcactcaggcctctttcttacagggcttcccaaggggaggcatccagaggaaggcaaaggctgtgatcaggtagaacccgctggacgcccccaccatctccctccatcaacatcaaaagacaagctgaccacccccaatgcaaggtggacattagggttaaaccctgagtgaccagcactcagctcccagcctggccgggatgcagtggggtggggtgtggtgggctcatggggctggtgagagcccggtggggtgggtttcaggtgctgcttgtccagggctcagctctgttccttggggctccctcagcccaagggcccacctcccctctgggcagccccgatcggcgtgttctgcctcggccagctgtcagccacctgcagctcctccctcattgcaccaccctggagcatcacggtgcccagggcaggccgtggagacctggctagcccatggtctgctcagtcctcaccagctgttgtgacagaaacaagtctgtgctgatgagctgagccgaccaggctgcagccctcacttcaggagagggtcaggcccagccaggcctggtgagcaggtgtggggaaggatgggtgctcatgtgcgggaagtttctcaagagtggtggaaggaggatagacaacgagggcccagtggatagggcggggaggcaggaagaggggacagagaggggaccagtgaaggagagtggagggtactgcccccctgggggaaggatggggtggggctggtgttagctgggttgggtgtgtgggtctggcagggagccgggcatgggagtgggtcccgaggaatgctaggttggagccaggaccatgggcctcaccagtcatagaagcctcacctcagggcagagggggctgacagactgggctgacgggaaggggggcttcctgtcaccagagaacataaagggaccactagtggcctgggccatgaggctctgtggccctcaaggtgctgagctcaaggtgggcccagcccatggctgcctttgtggggaccccacaaggagatgctggcctctgaggatgctcagacctggttcagcatggccaggccctggcctagcccaaggtcagcactggccactaccctgggggctgagtctccgtctcgccctgtgacatggtgcccacactatgagccagtgtcaaccctttgcccatacaccgggagccttgtgtgtccatactcatggctgagggcctgtttgggggtctctgtgttgggggaggtgggtccagggtgcgtggcccctgggattgttcatcatgagtgccacctggaaggtgctggagcctcacccgtcctccagagtgttttggggagatcctgtgctggcatcttggctgggccaggatggtgtctaggagggacccttgggagggaagcaggggcatcagggggcctggtgctggggtgggtggcaggagaggcctggagggcggcggcccaagccagtggctgggcaggtgtcaggagggagaggggtgaggcctggcctccctgccacagcttagccagggcctggggtgtcttggggtgggacaaggcccagggcagaggcagggctgcttgcatgcagggtggccacatcccggcctggtgagtgccggccactcagttctgtggccctctgctgccctctgccggccgcctctgtccctgcaggcccagccatctacctgcaggtctggacagaccctcagagcctaggctgggaggtctcaggagtcaagacagggttgaatcccatttgagggcatctgaaggagtgagagcctatgtcaatcccctgcccagccttgcctcggccagtggctcccaggggactctggtgggcagtggctaaagatgacagaggggctcagagaggctgagctgctctgtaaggttgcacagtgagcaggggccgagtggccttgggagaggcaacagcaggagggtcctcgtcatggccacagcccagggacaggaaacccctgctgggttcccccaccaagtagctcccattcccagcccttagggtgtctcaggagaggttccgggggaggtcccacctgcctcctgccttctcccccaaccacaccctaaatgggtcccagctccccagcccctcccacaagggctcacccgccagagctcggggagaggccctgcagggcggctgttcctccgtgtgctgcagtcctctggacactgaaagccaatcccatccatcttaatggcatttaatatgcacagtgaaagtcagcagccacagccacgggcgtgtgctcagggcaaggtttacacgcggatgccaccaggcttagcccatgagtggcctcctgggtcccaggagacctgtggggtgggggtgcagctgggtgggccatggtagcagagacctggggaggggatgtgggaggtaggaactgggctaggcagggactcaggggaggctgaggcctggaacagggagactgagacctcaaggaggctgggacattgggagtcaagacttggggaagctggaacatgggcaggccgagacgcaggggtttaagaatgagggtctggtgcagacctgagttggagcccagccgctgctggccccacgtagctggagagtgtgctgaccccatggtggctagagaatgtgctgttggtagggaaggcaagtgctgggaagggaaaagtgtggtccatttaaatgatacggaagcaggggagggaagtgctgggtagaggagggcatggtcccagactagggctccaaccccacggacctaggtgagaacaggcacttcctacccaaatgttgcatttctcacgaccaccctagcctgccacgcccccatcctgtgcttataaaatcccccgagaccttagcaggcagacacaggcagctggacgtggagaggaacacatcagcggagacacacacgggcggctggatgtcgagatgaacgcactgataggcaccggcatgctggcaggccactgactggcagaaccacacggagtttggctggggcagttggaggacagcccgggtgcacagcggccccactccaggggaaaaccttcccactccacccccttctagcttcccctatctgctgggagccacctcccctcaataaaaccttgcactcattctccaagtccacgtgtgatctgactcttctggtacacaaaggcaagaaccccaggatccagaaagccctctgactaacacaagccaccctacagacgacaaactaaaaaagcccccgtgacacacgcccactggggcttcagctgtaaaccttcacccctagacactgctgtggggtcggagctccacagcctgcccgtctgtaagctcccctagaggtttgggcagcagagcactgaagaagcgagccactccccttctcacacaccctgctagggcaacaagggaactttttccgtttcactggcccaaggtggctggacagtgtgctggccccacggtagctggagagtgtgtcgcgctccctggctttcctcctgatgtataaaatgagttagcgggtcctgggggctgttcccacagtgacgtggtggaggctgaccctgacacccacccctgctgaatgctcagtgaatggtggttgctgtcaggaagcatcattgctgtcctccatcagtgtctgtggggctaggtgactcttggaggatgcttccagcaacgttgcactgccaagacagaggccgtccacctgcctctgggcttcctggtgtgaacagatggatggatgcgtgggcctgctgcgtgcagggagctgaggctgggtcttcacctatgggcaggaggctacacagggctctgggagagacagcactgtggctgggacagagcccatgtgatgagatgccctcggtgcccctggcctccctcctcgctcctgcccctctggaacatcacccagagccccccttgctcttttgggggatgtctgggtgtctgcggttgctgtcactcttgatcccacccacccacccctgcaggttgctggcaggacaagtgcaggagtcatctcatggctttccctgggatctctgtacccgctgagagccgggagctgcacacagcctgtccaccatcctgggaactcaccctgttgctgccgcttgtcctgggtcatcctggggctcactccttgccattcagacccctgtgaggagagcactggctgtgagttgctctgtggctagtgatggcaaggcagggcctggagtagatccatcacgaatagttcttttttttttttttttttttgagatggagtctcgctctgtcaccaggctggagtgtgcgatctcggctcactgcaacctccgactccctggttcaagcaattctcctgcctcagcctcctgagtagctgggattaaaggcacatgtccctatgcccagctaatttttgtatttttagtagagatggggtttcaccatgttggccaggacggtttcgatctcctgacctcgtgatccacctgcctcagcctcccaaagtgctgggattacaggtgtgagccacggtgcccagctgagaattcttaatgaaatgggaacatgcctcccacgaaatgcacaggggcctgcagtgatagagtggcctcaggtatgtgcacaggtgtgaacacgccttccacagagggcagtggacgtgcacatgcctcacacacactgtggcgcagggcaagtgtcccacatgtgttcatgcttgcgcacatgtcagtgggctggatgtgtgtgtgcacacctgtgtcatgcctgcagagaagacagtggagagaaatatgcccaaatctcccctctgggtccctgccctgggtgctgggatgtcagaacaggtcgatgtccttttatccttccccatatccaccacgctgtctaccaaagcacgctttagttttataatcagaaatgaaatgcaccgtttcaagaaagccatgggccagcccctctgtgccctggtgttggcgggggcagaggggtggggtgtgtagggggagattagcctcatgcagccgtggggccagggaggccaaggtcagcttgctcagcacctggaggtacagcgagtaccaacaacacagcctagcttgaccgcggaaggaaaatcaatgctgggcgcaaggactgacggcagactcactgggaacactgtccaccgacgtcagagctgctcacagggcaccgggagcttgccagcgagcttggctgcctgtgtttggaacaaccctggtgggcgagcacgggcccctcacctgactccactcagtgcccttcccagaggggagacaaaggctgtgaacagctctggaggccctccctgccagtgccccccaggcctggctaaagaaatctcaaataccccgaagggcctggctccagcggcccctgctatgggtcagcctcagggggatgctcatcttcaattgaccctgactgttccacattacaagataaactgtggggttaactcaaggcggtattactttgtaaagactgctctttatacaagagcggtggatgcaaaaacaaaaacattgccatgtaagacgggagtcctccgagtcctgtcttcctccattccgtgtccttgcaccccatccatgtgtggcctgcatggacagacagcttcacacactcagactcttccctccccacgcatcagagatgtgtgtccctgttactgacatgcagggaggggctcatcatcttgggcacaccccatggtgctctgagcccatcatcacctatggtggacgttgaaggagttcccaggttttccttttcaggagccatggctcgggccagtgcctaggaggtcagaggttgggggcccagggagaggtcactgcccaaccgtgccaccttggactcagagtgccggcccagggaaccaggcaggcccggctctgaccgtgccgctgggcgaccgctggctgagacctggggctgaaacacatcccacatcagccaaggaaacaggctctgcatgaggcctgaagcccctgaagggctctgggacaggaggagagcccaagccttcagctgtgatgtgcacagcaccgtctgtcctccacccaagggaactcaccttggtgaccctgctggaaggcacaggttgctgacattctgacccctgacattcggacctccagcagagcctgcagtttgagacctctggttcaggagctgggactgatggggcccttggggattcccgtgctgctggaggaagatgggggcatgggggtgtccacagcaaagaagtgagaagtagaggccgccagccccccgccccgacccttccctggctagagtggggcaggcttgggggtgagtctggggtgctgatttcaccctcctgggccaaagtctccccgtgactttatggactgtctccctgtgctccctgagaccctggttctccctcaccagcctgggtccttcttgtctcagctcagctgtcacctcctccgggaagcccccaagcccttgagtgggtgcccagcaggcatggtcagtgctgaggctacaagccctgccggcacccggcagggaacacaaggccaggtcaggctctggggacagtagacaagcttatccctgcacactggggactgcccacctgggggagagagctaggtcaggctggggagacgtcaggggatggccgggcacccctccctgaggagagctccacctgagcaagagtgtcaccaggcccactccagacacatgcactgcctcagacgggctggagagagggtgtggccgggccatgggatgaaccattctgggcggttgtcctggcatcaccagacatgtggctctattaagcatctcgactccacaggagcccatgtggcatgtcctctgacctcctgttcacttctgaaaggggcggccctctgagattctgcctggaacctgtcagccctcctgacaaggtctctggttcccggccatcacaggcacccagccaccctacagagaggctctgggaggctcagccttgcctggggccccaagactgatgccagctggggcatctcacagggagcacccctacctgtaaaccgcccagctcaagccctgcctcgacctctccaagtcagcagccgaccttccccagggcccctcccagcctgcagggggtctgaggctctgaggcttttctgcagcctctcagtcccccaccctgctacctgctcaggcagagagatcatggctctgggttattgtgtgcttagtgggtgctggagctcgtgctaaacaacttgggtgccccctgaatcttgacaataatctgagggggcattattattactattctcacttccccgaggaagaagtcccaaaccccgtctggcacaaagccagcgccccgagtctccctctgcagtccatgtgctcccacgtggggcatgcctgggacatcacaacatctggggtcaatgcggctgctgttgtcactgtggcattcagctttcccaaggctcacatctgctccatccagcaaaggggtcttgcaccccaagcctgcctccctcttcacacacacaatcccacttcgtcaaccacaaagatgcatgggtttacccagcctcaaccccatcggcccctccccttccagttgccggagggctcgggccccttcagctgggctcccacattcctgacccctggcctgcaggccctcaagactatgccagcccgggctcacctggtgccagacacctgcatctccctggggtgggggttgggggcagtaggctccgtggacctagcacacgtatgattcttggaaaatgtaaatgtctctgaggacagcgatcccagcttcaaatattgctgtgggctctcgggcaagtccctcctcctctctgagcttcagtttcccccgcataaaatggagcagtgatcgtagctcctgcatgggaaggttgtgaacaccatgcttgtcagcagaatataccctaattttgcaaggaaacaatatggcaggggtgggggggatctaaatacctttccttatacacgcattgaaaatgattatataaagtggtgaagtgtgattgcattcacataaacagtggcatgttctgggatctagcagacaatcttaacttcaggaaatgcaatcatattttactagctttgagaaaagtgaataaaatgtcatagctaaatagaactcaagtaggatctgtgaacggcagcatggagtggataaggggataacgtaccgatgagggaatttatatacccagcagcccaggtttggtgcaggctgataacggaaagacaaactccaaattaaatgaatgtgaatgaattcctttgcctgcggacagaccaaaaatatcggtaaaagtggctacagggcaagcagaaaaatgcaacaaattagaatgaacgcagggaaccatgtttctggcagagaaacaaatatttcagagtacaggtaagaggcacatggcaaaaaaaacaacaacctgactttgccagagctccaatgtcatgctcacggctgaggagaaacaattatctcgctgggaatgagtgcaagtgagagaacggaaggagtcctgagcacggttgactgcatgtgcccaggggcccggacaggcagcacagcggcctctctaccctcgaaggtctgtttcttgtctgcttcctccttgagagtggcaggccctggtaactggcccaacctcgggggcgcccagcagctgggtccccaccacatgcccaagtctggccctctcagatctgcctgtctcctgagctggagaacggagcccacccctccatccccgacactcatctcccatccagttgatctccctgaggacccccccaccgacaactcccacctggatcccctggccctggtggggcatcattctttcaaaataatccatgactgtgttcagtggctcacgcctgaatcccagcactttgaaaggccaaggtgggaggattgcttgagcccaggagtttcagatcagcctggggtaacacagccagaccctgtctccacaaaaaactattttttaaaaattagctgggtgcagtccagcctatagtcccagctacttgggaggctgaggcagggggatcacaagcccaggagttcaaggctacagtgagctgtgatcacatcactgcactccagcctgggcaacagagaccttgtctcttaaaaaaaaaaaaaaaaaaaaagccatcagctggctcagggtagccacctgccaagggtccccagctgagcgtaagacctgcttcctaggatttacagagctcctgtgaaactcggttgtttcattgattgtcacatggagccagtgactttcaggccagccttgttcccacaggtgggctctcccgtgggcctgggcacccagcgctaggcctgccctgctatggtctggatgtgagcagagatctctgtgatccctgtacccctcgcttctccccctgccctctctgcagccctgcccctggcagcccctgcccaccttcgcctctgtgcagggccacaggcttccttgaagcaaatgctagaactttgagctctttgctttttaaaaaaagataacagctttattgagatataattcattatactattcatttattaccttttgcattataccatgcaattttttccatttcaatggcacaatcgaatggttttttagtctatacacaaggttgagcagacatcaacactctgtagccccagagtatttccagaccccaaagaaactccgtgggccttggcagcccctcccactccccctgtcctccacctccaggcccttaccagtgccacagtcaccaggctacattatgggcttgtcttcgtgtgacttctgtctctatgggtttgcctattctgaactcttcatataaactgaaccataaaacttgtggccgtctgtgtctggcatctttctttcttttcttaaaaaaatttcacttttattttagagacagggtctccttccattgcccaggctggagtgcagtggcacgatcatagctcactgcagcctcaacctcctgggctcaagcaatcccctcacctcagcctcctgagtagctgggataacagacatagaccaccatgcctggttaattttgtatttttttatagagatgaggtcttattatgttgcccagactggtctagaactcttgggctcaagtgatcctcctgccttggcctcccaaattgctgggattacaggtgtgagccaccacacctggctatttttattttttaattgacacataataattgtacatattcgtggggtacgtagtgatgtttctatacatgcaatgtatggtgatcagatgagggtaattagcacacctatcatctcaaacatttatcatttctttgcattacgaacactcaatattctctttctagctagctgaaaatacataatttttgttttggtttggattttggtttttgttttttgtttttgagacagggcctcactctgttgcccaggctggagtgcagtagcaccatcacgactcactgtagcctctacctcccaaggctcaggtgatcctcctgcctcagcaacccgagtagctgggactacaggcatgtaccaccacacctggctaacttttgtatgttctgtagtgatgggatttgaccatgttgcctaggctggttgtgaactgctgggctcaagcaattctacccctctaggcctcccaaagtgctgggattacaggcgtgagccgtgacacctgacccataatatgttgttgttaactagagtcatcctacattggtgtagaacactagaacttattcctgccatgtagctataattttgtatccttcaacacatctctccctccctctccctcccttctttccacccttcccagcctctactatcctctgttctacttttgacttctatgaggccagctttttttagcttccgcatatgagcaagaacatgcggtgtttaactttctgttctgtctcatttcacttaacataagtttctccagttccatgcatgtgactggcttcttcgattttgcatactttcaaagttcatccatgtcatggcatgcattagtacttcattcctttttatagcttaatagtattccactgtatggatggatcacgttttgtttgcaccgttttgctgttgtgaatagtgctactgtgcaccagggttgtattcctctgtgtgccactgggttgagggttgggggatggtaggtgctcccataaagggggaaattgactgatactggctgaaatggaccaggctcttcattaagctggcctctgaatgttgcaaaagcattctgttggtttccaggatcactgcttaagacggttcctttcagtaccactgttgtccaggggagggatgggttcccggagcttcctgatctgccaccttctctgatgtcaccctcagaccctctgcttttgagccccaggctacagagtaaaagtctgatggtaggatgtgaggtgagggaccttccttgacccggcacccacatgaggcaggactgagaacaccctgaggactgcccgggtggctggggtgctgaagccaggcttggcccctccacaggccatgcatgacaaggaccaccctgtctctgagctttgccttggccttgccgtgacattttcaggtgtgtttcagcttagattctgctctggggtttcccgtgtaagaacagggatgacgtctaagcccttgtctggcatttgtcaggaatattgggagaggcaatgtggcagtgtgagaaacaagctcacccatccaaacctgaagaatggactcagaggcacgagcagtgaaagtgagacttttttttttttttttttgagacggagtctcgctctgtcgcccaggctggagtgcagaggcgccatctcggctcactgcaagctccgcctcccgggttcacgccattctcctgcctcagcctcccgagtagctgggactacaggtgcccaccaccacacctggctaattttttgtatttttagtagagacggggtttcaccgtgttagccaggatggtctggatctcctgacctggtgatccgcccgcctccgcctcccaaagtgctgggattacaggcgtgagccaccatgcccgggaaagtgagacttttaatagtggtcttgcgagattggtgtctggtggataggcgcactcagggcagtcacagcaagtaacttatgccctagcacacaagtccctcctcctcattggtcgagtactatggggttacaatcttccaggacattgcctaagtttcattatccaccttataaggttataccccgtcgccttccccgcttaagtttcaattttccaataacgaaactttcttcccttttatgggctgaccctttttctacattctgtctgcttattgtgatcttctacgtgcatgagccgtgcggtttgttacattctcaggctggctgccagtacttagatttatcatgccttgaaaatgggccatttaaaatgttttctcatggcggtaaatcggtgagctgactgtcatacactcagtcattttgcccaaagtgtgtgtgatgtggagggctgacagccttctccattaccagtgcagtgagaggtggcacagctggtgggaccccctctctctcatggatatgagtgcgttagaggggaggtcttgggccaggagcagatcagatcaacaggattatccagaaaatggcagtcatggcgagtattggctccagatggggagggttagggtcagggtcggctcttctcaccttcctgagcgagtcaccagcgtcgacaagttactcccaacatacagggcctgggtggaggctgagtgctaggaacccaggctccaattctggtaaccaggtgcagatgctcaggagaagaatgcagcccagacaagcgtggtgtgccctccagaggagaggacgtggcatcaaagggctgtcttcatggagagcaggaacagagactttgggaagccagggggccttggcctcagccctgctggcagagggtccccaccatgtagctgaagtgccagggtgcttgtgaggactgggtgtggtccagggtgactcagggcaaggcctgggggatgcatctcaaatccacagtcaccagcctagaaactggggtcacacttcccacatgggttcccacatgtggaaatttcattcactaaataacgacacatcaaggcagcagtatggatggggcacagctgtcaaagtcaccagcaacaagtgcaagaagagaagagggagttgcagccacataggtgcccaggtgggccctgggggtcagagagggcctgccaggggtagcacccaccatgctgaccctgatgaggagaggaaggagggtgtgggatgcaggggagggaaaggtgcctgagagcagcatgcaaacagcctgggctcaggaagagccgatggcatgacaggtgctggggagaaaggcgtgataggtgtggacaggggccacaggaggagggatggtcctcaggaaggggagactggtggctatggccggctgccgaggctagcctctctccagcaaaatgagcctggattcatccactccttttgtctctcccctttgctctgtggtgccggcaggaggaagaggagcagaaaaactgttgctccattcatcaggaagcctctctctctctcgagtggtggtgatggtgtcccccaggggcacctggcaatgtctggagacatttacggctgtcccgactgtgtatgtctgtgtgtgtgtgtactacaggcctctggttcctggaggccagggatgctgatacacaacctgcaatgcacagggcagctcccacaaggaaattattcagcctcaaatttcaacattgcagaacaggtcagggagtgcaaggtacctcctgctctttccagcaggtgcaaggtgcacagggagaagcaggtgggtgaggtgggaggaggctggagccagacccagcgtctgtggggtgcaggaatatcgtgaggtgacgaggggcccagcggtgagtgatggggaggggtgcactacggcaggccgccaggggcggttccaccaagaaagtgacatctgggaggggcattgaggcaaaggggccgcgagagggtaggtgctctagaggtggcccacgggcgggcggcactgaggccgggcctgcaggggaggcggtgtggccagcggactcttgttgggtggcaagggaagggaagaaccacagggctgcacaggttccgagggggcctagtggtccgcatttgcccttgggtgggcggtgggactgggaggacaggagaggagcgcggggcaagcccctaagaggcctgaggggtgggagggagaggacggcttcccatacgcccatttagaccagaggagaagcggacccactttgagggctggattctcagccgatccggcctcagctgtgggtccacgcggctcaaggaccagggaggaacccaggtgtgcggctgcgctgatcggcgggctccggacccacctggctggcctggggacctgggaaacccggtgtggtggggagaccgcaagcctggtcaggggtcccgctcccaatggggcgggtctcctgtgaggaaggcggagctcagggcgggtagccccggggaccgggtctctcgcgggggtgtggccacggcccggtgggcggggcctgctgtggacgcacagaggtctgcagcgcgcggggcggaacctcccgaggagagggcgcggctgggagcgcggggcggggccttccgaggagagggcgagactgggagtgtgaggcagggcttcccacggaatgggggcgcggagccggtcctcccgaggagcgggcgcggctgggaaggcgggtcgggtcctctcgaggagcgggcgcggctgggagcgcggggcgcggcctcaagaggagaaggggcggtgggtcctggggcgtgccagaacccttgaggaagaagcgctggtgttctggagtatgaccaccggagccggccgggcctcgggttggggcggggcctcaggggtggggttgggacttcgggatgggttctccagaggtgagagctggggtcgtagggtggaccggcgtctgctgaggaaagggagctgcttggagcgcggggcgagggactcacgtggagaaggcgtgggccctacggcgggcggggcggggcctcaagaggagcgggtgcagatgctagggaggggcggggcccctgggatggggcggtgtctcccgaggagtgggcgcggctcggagcgtgggacttctaaggagagagcgcggctagggggcatgcggggcggggaggggcggggcgggaccaatagcgcatacttaagcggcccgggcgggtaccggcgtcccgccatggctctgcggcgcgtcttgcccgcgctgcgcccctacattccccgcttcgcgccgctgtccacggcgccggccgccagcgagcagcccgccgcgggcccaggggccgtgccaggacgtgggtcggccagggcagtgcggccgctggtgcccgccgtggacttcggcaacgcgtaggaggcgtactgcagctggcgaacctgggagctggcgcgcagcctgctggtgctgcgcttctgcgcctggcccgcgctgctggcgcgccacgagcaggtgcgcggggtgcagccggggcgcggggcttctgcccgtcccgggagcctttacggagtttcctggcgtgaaacgggtgcctcccaagcatctcctggagcaagggaagccaggaagggaggcgtttcctgcagtccctttctgatatcgcgaattttcctacttctcgatgtctaccaactaaaaacaatggtcgttttaatatttacgatatataccacttgtgggaatacagagttatcacttggaatttaaaatggagtattcttcatgttgacacaagagaagcctggtgtagggctcatagcctggaaccccagagttcaatccccgggacccagccgcttcccagacacggccactctgagaacactgttggggaaaaatgggaagcccctcaaacgcccagctttgaactcacccatggtaactttaaaaagtgtcagggcttttggtggcggtggtggggggcaacaagcagaacactgttttagccgcatcagcctaggggtactagagatgacggttatctccaggtgaccctgggaagagtttgcaaggttccgctttttggcgccagggtatctggtggtgttgatttctcaggtgagactgtacagaggtcgggggctgcacccctggcctcaacaggaggcgggggaaggcgggggacggtgtgagatgagaagcaccgagccacacttgagcttaggtgaggcctcggcgggtgcgaggtgagggcagggatccacgaactcagagtcagatgctgttggcccgaatcccatggggagcgccaaggtcagcctaggacccgtggtggcgggagtgcggaggatggtggaggaagaaggagctgaactggacagatggagggctctgggagggcactgctgtgcttgtgcacacaaggatgtcttaaggtcaagttttggccatagagagccccggccaaggagacaggagggcgagaagggacatcccaggtagaggaactggcaaggtgagggacggcgatgtggaggctttggggagtgcccacatctaaggggcatcccaaaagaggagccagtgctggtggtgctgcaataggaggaggaggcagcagggcaggaatgccaggggagggagtggccagccacagggcaaggacgggcattctaggtggcagctgagtgggacagagactagccatgcagaagccatgcccaccttgtggccaggatgtagtgggggctaggaaggcaccaggtcaggtttcttttttcttttttttctttttcttttcttttcttttccttccttccttttcttttctttttttttttttttatggaattcgctctgtcaccaggctggagtgcagtggcgcgatctctgctcactgtgacctccacctccctggttcaagcgattcacctgcctcagtctcccgagtggctgggattacaggcacgcgccaccacacccagctaatttttgtattttcagtagagacagggtttcatcatgttggccaggatggtctcaatctcctgacctcatgatctgctcaccttggcctcccaaagtgctgggattacaggcatgagccactgtgcccagggagctggtgccgcatcttctgcctgggaatcccttcctgacacagcctctgggggccagagatggggggagcagggctccaggggtagagaagccagaggtcactaaggcccagtgtccttccgtgttagaaacacccgaccctgcacagccccatgctggccccagcagccctccgtcaggggcagcgggtcccaggcctgtttatgtttttgtttgtttgtttcaaatgagactgggtcttgctctgttgcccatgctggagtgcagtggtgtgatcatagctcactgcagcctagacctcctgagctcaagccatcctcccacctcagccacttgagtagctgggtctacaggtgcatgccgccacacatggccaagtttttttttttttaatttttgtaaagaggaggtctcacagttgggcgtggtggctcatgcctgtaattccagcactttgggaggtgaggctggtggattgtctgaactcaggagttcaagaccagcccgggcaacagggtgaaatcctgtctctaataaaatacaaaacattagccaggcatggcggcaggtgcctgtaatcccagccactcgggaggctgagacagaattgcttgaacccgggaggcagaggttgcagtgagccgagatcactccactgcactccagcctgggtgacagagtgagactccgtctcaaaaaaaaaaaaaaaaaagaaaaaagatgaggtgtcactatgttaccctggttggcctggaactcctgggctcaagtgatccccccaccttggcctcccaaagtgctggaattacaggcgcacactaccacacccagctaattttcatattttttgtagagatggtatttcaccatgttgcccaggctggtatcaaactcgtggcctcaagtgaaccttccactttggcctcccaaagtgctgggatgacagggcataccactgcatctggcccttctgagcagtgcttggaagccacctcctgacgggggctgggggtcagagtggccagctgaatgctgggccatcagggtgaggggcgttttctcctcatccattgcctgttctcctggggcagatgtaaggggaaggccctgcactggggtggtgttaaacaagatgagatggtaagatctgctttcactttaaaggaacatttctggttgttgcttggaaagaagtgtcaggggcaagaatgctgcaggagggctggcctggagggcagggtgggactgcaggctggctgcacgggggcaggagcctgcgcttgcgtcagaggttcctgagagacttgggctctggggcagaggcctgagcaagggggcctcgctggggtgtctctgtcttagccacactcggtgtttctgggtcctgtgacccatgtgtgagcagcctgtggtgctggtggcacaggggaggaaaccgaggcagggagcctgtgggggctgctcggcaggggacaggcagctcctgtgcccactgctgtcccacacctgcatggaaacacaaaccccaccacggagccccctctcatctctacagggcctccagagcgccatgtgcaagaacttcatgggcggggtggggtggggtcaggagcctgctgtgggctggccaggcatgaacaccaagctggaggtggcggtgctgcaggtggggcagccttccccttccccactcctgtggcttgtgagggggtgggcaccgtgggggcgcacagggggcatggtgggcagtggtcggaggtggttttgggaactcacccagggcacgtggctcactctgcagctgctggggttggcctggtggggaggaggaggtcggagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaagaataaaatgtgagcgaatggggctgatccaggccttctcacttctcaaggaaagtgtcgcaaagatgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccttgggatgacagtgctgaaggaactgcttttcacacagcaggacttgatggcctcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggggccaggggctgggacccaggtcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagccctagggtactcagtgttttcagagccgcctagatgcaggactgtttgtgttttggttttaaatttttttaattaatttattttttatagagaccaggtctcaccatgttgcccaggctggtttcaaacccctgggctcaagtgacctgcccgccgcagcctcccaaagtgctgggattacaggtttgagctactgcacgccactggttttaaatttttaaacagaaaacaatatttacatttcctctgtctttttttttttttttttttttgagacggagtctcgctctgtcacccaggctggagtacagtggcgcgatctctgctcactgcaagctccgcctcctgggttcatgccattctcctgcctcagccttctcgtcttttaaaactgaacactgaggtgggttttgtggtggttggtgaacggacaggtttgggcctggatcccccacccgaccctagcacccacaggtggggtcgccaactctgctgatgtgcctcctccctcagcactgtggacctgctggactggagcagcctcatcgacagcaggaccaagctgtccaagcacctggtagtccccaatggacaggtaacacctccgctcctcagtgaggcccagctcagcagggcgctgcgctaagaagggaattcagcctgccacatgtttctcttgttgcctaccctgggaacttaacatgaccaagatcactgcacactatggccccacagaccccctatggtccagggggaaaagaagacaaacccactagtgtccacagagtgcttggtgggacagagacccacgcggagccttaaaacaccacaaggagagggggtctgggggccttccccaagtcatctgtcttgtgcatcaggtcaccccaaacttcagaggcctaaaacggcagcagccactctgcttctgcctcatggttctggggttgacagggctcagctgggcagtcctcgcttggggtctcctgggtagctgtactcacagagtggtggcgctgggacctgggggaggcgcccactcacatgtctgggagttggtgctggctgtggcttgggctttttcccaacatggcagctgggctctaagggccagtgtcccctgagacgtgagagccaggcagaagctgggtgaccttttcctgcctcacctcagaagtcacacggtgtcttttctggcaagttctgtttgttagaagcatgtcaccaggccagcctgtatactgcggggagaggaatgagactcatctgcctgtgggaggggggcccaggacctggctgactgcttgaaaccacaacctaaactggaattcgaagaaagaacagaagcaccttcagaaaacatcctgcagaggcagctttccatgacacatctagccccagtccactaagggcccagcctcaaactcagagcccccgacccagagcctcggggcgcagtgcgtacagtgtggctgtgcaccaaggccaccagctgttggagactttagcatggtgtagcaagggatagagtggtactgcttgtgcccagtgaggcaaggctgctggggccagcaaaggggtgagcgggaggccctgcgggatgggtccccacggcctctgagcaccagctccttgaaggcctcatcctggcggttgccctggtccctggctacgtgtcagcacgtgctgcacaactgccctgtctgcctgtagccaggggtcttcctcctgggccctcttcctgctctgggtggagcccttctgtttgacgattgggtggtcagtgttcacttcctcagtgtcacatgggagctgcagggggccctcccacaatggtggggcctctgtgagaactggggaggctgttagagtacacacttcggagtgcaggcctggactgagcctggggcccactgacatgggcactgagctccctcctggtacccccagggcccgcgtagggcagtgcactggctgcgttggaggttccggggctctgtgctgcttgtccaggtggccctccctcccggccctgcatgagagggttcccgtgggctgggaacactaagagaggtttagcctgggcctcagggtggcacttcctggcccttgctgtggcctgaccatgtgctgtacccccagacaggacagctggagcccctgctgtcccggtttgctgaggaggaggagctacagatgacgaggatgctacagcggatggatgtcctgcccaaggcgagctgtcccgctcgggcagagggctggggccttggggacccgggactcatgcagaagagggcacctgcctcacttgagcaatagttgctcccactctcccaccccctgcgcctctcagaaagccacagagatgggcgtgcggctgatggtggatgccgagcagacctacttccagccggccatcagtcgcctgacgctggagatgcagcggaagttcaatgtggagaagctgctcatcttcaacacataccagtgctacctcaaggcaagcccccgctcagcccctccctgcctgccttggggcttggagaccccacaggaggggctcctctcatctgagctccctggcatttgcctggttttatactcagcacccaccagggagctcacgggatggaggagggagtgggccgtgcccccaaggggttgttggggtcttctgcagcacagctcacccagcgggccccagggtccaggaaagagccccttaggtggtggccacagccaggcctgcagaggaggccgaggccagggtgactgcctcagagtagcaagaaaggcccgctgcccgcagcctctcccctggttctcagaaccagccaagagtgtctaaggagcaagaggaagacaacgatctttatgagggtccactagatgtacccgacaccccaaacttggaaggtgtcacatgaccatttcctccagcgtgttttcagttcagcgcccctaagaacctcatgaaagctttgggccctccccggaaagactcacccaggatgtcacatgtattcagggagcccatcctagcctgtgggccccaaactgctcagggatgttagcaggtccagagctctcaggggtgagccgggtgcccagaggacacagggtggcatggggagggggtccaggcaggagcatgcagtatgcacccctcctggtcggcctgggagtctggagcacatgatggctgctggcgcctgggctgcccccatagggctgtccacaggccacagaggaagctgcagatgtccccactgccattgctccctggagacagaggttggagaaccatcctcacccacacctggtccaggtgccttgagctgcacctccccaggcagctgctgcccagccctggtgactgcacctgggcccaggaaggccccatcctgctgtcacttgggcttgcccaggctccctgtgacttttggccctggccccacaggatgcctatgacaatgtgaccctggacatggagctggctcaccgtgagggctggtgttttggggccaagccggtgcggggcgcatacctggcccaggagcgagcctgtgcagcagagatcggatatgaggaccccatcaaccccatgtacgaggccaccaacaccatgtaccacaggtgcgcagctctcccacccctctgtcttctcagggcagggcgccaagaaaccaggcctgagggagaggcttggagactgaacttgtcagccacatgtgtccccaggtcagaactggtatttcctcagcttttatgtcatgtgttactttttcaaaagcattaaggttattcttttataaatatagaaaagcctattgaacaaagtaaaattggccacagttccctgagcctgctcctgcagacacttagatccagagatgtgcatgaacactcggtcctccccaccctgcaggctcagcctgtttgcttttcagttcacacagtgggatcgcccatcagctgttctgcacctgcttttactgctctagtttcttggtgatcttttcatgtagcacaggctggccaaccatgggcttttcctcttagaggcgtgtgtgcatgctgcaaattcagagagaccccaagtgcctcctggttggctccagctcccctcctgcagccgctgtgcatgtcgtgccacagcgcacacatctccgccattgttgtttgcgctgtagcgtgtcctctgcccgatgtgtttttcatttcgcgttccatctgggtcctcttgtgtgggcttgcagagtggtgctgtcaacagccagcatggagtgcccggggctatgtgtccagcatctttgatcttactggttttcagtctggttattgtaacagggactcgctggacataccgtcaccctctgtggtacacacgggccgtcaggggttttgtgtctgaggatgcagctgtcctaggttgctggaaatggaattgctgggtcagagagaacgtgcgcgtggtcaagcctgctgagtgtcctcgctgcaggagggccgtactgctcgggcttcctggtgcaccgggatgcccacccccactgtgccctacagggacctgcttcccttttatttcctttcagggccaggggtgcactgtacgatccctccccagacgcaaagctgtgtctgtcatgaggcttatgggcatgtttgggctggtccccagagtcacggcatgtttgatgcagggacgctgtgccccagctggttctgtgtgaattgtctggtcccagacatcgcttttgcttggttgctggtctttctttttcatgaggtgctgggaggggcagatgctgctcctgttcctcctgatcctgtggatacccttggaaagagccagctcactggatggatctgggtctgccttcggcctcctctctgtgcagctggtaatgagaggtgcaggcgaccacaggcctggaactgggctcacatggcactcttcacaggtgcctggactacgtgctggaggagctgaagcacaacgccaaggccaaggtgatggtggcctcccacaatgaggacacagtgcgcttcgcactgcgcaggtaggtgtgccccaccctgcaccgaaaccccaacctgagccgttgtctcctccagctggggagaggtggcagcagtgcagagctcagggtgggcagagtgacctgctgggtggtcgggcatttgtggggaaaggctggtgaaatgagctggagggtggcttcagtgggcaggcccaggcccgctggcattctggacatcggactgtgagagcacaatggctctttgcagttacgttggtttttaaaattaacttttttttttagatagaatctcgctgtcacctatgctggagtgcagtggcgtggtctcagctcactgcaacctccgcttcccaagttcaagcaattcttcatgcctcagcctcccaagtagctgggattacaggcatgtgccaccacgcctggctaatgttttgtatttttagcagagacagggtttcaccatgttggccaggctggtctcaaactcctggcctcaagtgatcctcccttcttggcctcccaaagtgctgggattacaagcatcagccactgtacccagccttttaaaaattaacatttgacttattaaacttcacaattaaaaaactaaatttcatcagggtattcggatggctcctgaaaggtacaaatgtagtgttggagcccagtccctcaggaggcctccacagcgctgcctcatttataagcagttcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagcccaagctatgcacacaatggggtcctaggtccccctcccctcccagattccgccttcccagggatgggaccccctagaaccctcggaggcctgggcagtggcctcgctggctctcgccttcctaggagctgagcaggagctccactctcagcagggcagggtgccccagatccatgacttgtggcacgaaggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcccgccctcagcagggcttcctctctccagcttagccccggcacctgtctgtccctactatcttgctgtggcagtggcttccccagtggacacagcttccccctcccgagtggcagccgggctctctcctcttggccccaagggccctgtgccgggctcccccagtaccatgctcacatccctgcctgagaggctggacccctgcaggcttcagctctgcccctgctgtgggtggctggggagctctggggagctggggtcccctcccatgggtaagtggttctagactatggcagctgctctgtcctgtgctgggcccagactgccacaccacccaccctcaaacaacccgagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggtgtagtaaaggagactacatcctgggtccagcgtcccacaggccagcccaggcttgggcacgtggtgggctcaggcttccagaaggcctggagagggcaagcctctgcttgtgtcacctttggtacctccctgttggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccgacactggagcccagcccagggatggagggaaagggcctctggccgatgggtactctgggagccagggctggggcagatggagaacaggggaggtgaggccctcggggagggagtgggaagcacagcacaggcactgccagtcacccgggtgatgcgtgagcagcaggcggaactcgccccaggctgggggacccagtgctgtgcagaccagcgaagtcgggatacctggatatagtaagctggagatgaaacttgagaactgtcactgcgtggatatttcaaaccctgagaatctttgtaagaccctatacggggtggtgtgaagacaggacagagtggaggccccaccccagtatctgagcagtgctaatagatgtataatgcaagccacatctgtaatttaaagttttttggtagctacgttaaaagataaaatgaatttcaagaatacattttaattaacccaaaatatacaaaatattacttcaaattgtattcaagttgattttagaaaagcaatgcggcatcgtgcatttttctagaaagtctcctaaatcccgtgtgtatttgacatttgcaacacatctcgattcagagcagccgccttccgaggactcgggggctggtggcagctgtgtgggacacagcagctgtggggatggggcagagcagcagcccacagagggcgagggcaggggccggagaccagtcataccacagaaccctggaggggcttgaggaagggatggcaggagagctgaggagcttctctgccctgtggggcaggctgctgggtgggtcaaagccccagaagggctgcacctccaagaagggaggtagaggagaggtgggagagaggagggtagggaaggcaggaggggggccttgttggctaagggctgaggcctccccagggagaagagtagggcagcccagcagagtcctgctgggaagaggcctcactgggagagggccggacagagcctatatcccaaccccacttcaaaggggataaagtctggagagtgtagatgggggacctggggtggcaggacagggtcagagctgggacaggggccctgtacccctgcaccggggacagtgtcctggaattagccctcagctcctggctttacctgcacaggatggaggagctgcgcttgcatcctactgtactttggacagctgctaggcatgtgtgaccagatcagcttcccgctgggtgaatggggccctccctggtgcgatggagtgtggtgctgggcctgggcctcatggcattatctgcccccatgcaggccaggctggctaccctgtgtacaagtatagggctgtaggtgctgtcatacgtgtcctgccacgccctggagaacagcagcctcgtgaagggtgcccgtcgggagcggcagctgctgtggctggagctcttgaggtggctccgaactggcaacctcttccattgccccacctagcacccccccgcccccgcccaggccatcaccacagctgcagccaaccccatcctcacacagattcaccttttttcaccccacacttgcagagctgctggaggtggagtcaggtgcctcccagccctgccaatggtgggggcactcaggtgtgggctgaccctgatacctgcctgggatagccgctggtaactgttaggaactttcctcggatgtgtgggcccaaggcccccacctctgtgacccccatgtccttggacctagaggattgtccaccttctcccaaggccagcccacatagcccgagcccctcggggagcagtggccgggctggggaggcctgcctggtcaataaaccactgttcctgcagctgagagccctttgccctcacacagggtcagctctgggcaacaaagagggagtggctcagacagggtcagagaagtctcatcccaaactctggcttccagcatcatctgttcctggaggccaggccctgcgcagacctggccacccagggtgctggacacccccaaccctgactccacaaggacccagcagggcccatgggcccaggccagcacggaggggactcatgcagatgcagaagccaagctccccaggtggccctggcatgcctccccgcagggctcctcctcaggccattcctgccaccctgagtcctctatcccagtgacctgcatcaggctcctcctagtggttcccacaggacactgaccaggctgcggcaggcgcatacttgcactccgggccttctcccatgctctccagcccccagccccacaaagcaggctggatgtggtcctcatgccctggggcttggatgggggcccctgtacagatggcagtgacagcatcctgggaccagggctggggcaggaaaggctggagggtcccagtctccaggcagggggaggggtggtgggctgggcacacagcccaggaaggggcccccaggtagaggcctctgctgcaacagaggtgggggccctaccagggccccggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgtgaagcctggtcatggcctgccaggacagggtggaatctgagcttctgcccccaacagggccactcggaatctgagcctctgcccccagcagggccactcggaatctgagcctctgcccccagcagggccactcggaatggcatgcgggaggggagcagaagagggccctgtgtggcacagcaggcctggagagggtgggcagtgcccatggctggctggctcaccctcctgtagggaatgggcctggcctccgtgctgggaatggcacagaaatcctttccagagcctcaatccttccacttcacccccataccctgagcctggctccccagggaccagcagtaaaaccccagatggaatggggccccggggcactcgggctagggcagagcaggcccaggcactgacctgtgggttggtggtcacgtagaagccagccacccccgccttctccagtgtgctctgctggtcagccaccttccggtccagctccaggatgatcttctggtccatcgcccgctgctcctcacggatccggtgttccacggcctgccatggggccagggcgcggagggggagaggtgagggcagctctgccatcagggggcggggaggtgagggcagctcaaacacatgctcctgctgccgtccccagtggcagcagctctgacaccaccggtgcatcctcaccacacccaggcctctcctcggccatgtgaacccctgaagggggccccaaggggcttccacgaatgccctggcttgggactgccttaggaccacacacacatctccacaggcacaccctgccccacggcttgttggttacatgccagtctctggttgtccctgtgctccctgggagaaggatgggccccttcctggccccaacaccctaccattgcctttgtacccccctgaggccacctgctctgtggaggcccaaacccacgaggagctgctatccaggggagcactggtgggttctcaacctccacccagccccagcacacttggtatccgcaaagaggagccacctggtgggactcactaggcctccagtgtcccactcaggcccaggacagccacccatgcctgagcccccacaccccttcagctcagcccagtcagcagagccaggtggtgcccacaggagagctgggccggccaccctgcctgcgcccccagtacctctagttctcgctgctgagccgcctgaaccacaggcaggttgtggggccggcaggcctgctgggcttcctggtgcttctgccgcagcgcctgcctgagcactgggagggatgagagcccgtcagcaggcggtgggactcggcagcagccctcacccatgggcacctgccttgccagcccagcagagcagccaggccaaaggggtgtctgcagtggggaggatgccagcctcctccatcctcccaccccactgtcacccagggccgggcccttatctggtggcaagtctccaggggactccagaaggtgcggggcactgaaagagtggggtggggaagactggccaggtggggccaaagctgcagccccagacccagggcagctggaggaggcaggcgggagggaggctgcagtctgagggcttcagggcccccatggccacaggccatgagacatctactcaagtgtcagagaccacctcaggcaaaggcatgggaaaggagcaggaggagcggggtcgctgaccctgagcgtggggcctctgcctaccaggggtgtggtcgggccctccaccctcagtgctgcccttcagggtagacagcccctccctcatttgcagctcccagcccccgcacagcgccagagggagaagggtgggcagacctgggaggcccaagtttgggatgagcttggggtgccataagcctgtgtggctctgaggggctcaccctcagccatcaagtaaagctccacggtccttgctaaactgtgcacaaacacagatgtgtgcaaactgtctggtctgaagggaatgtacagaggaagcgatcatgggacataaaccaccatgaaacagaacatgcagcaccccacagctggcgccagtgaccagtaagtgccaaatggctacagctccccaggagggaggggtccctggccaaaagaaaaggtgaaacccaacactctgttcctgggaagagccctgatgttgcagctcttctctggtggccagtccccagggaactccagggcccctgaggctcccctgcaggtagcctggctcccgctgtgcctacagccttccccgatctcctgtctcttcacattctgtacacacctcgacgatggtatttaccaaaagcccccctcaagacagctccataacacagggaagcagggaaatgtcatctccttcactctactgatcaaacattgctacaagtgccaggtccactaccagattccactagatagacaaccaaaaggcaagaagagagccacgctggctgcctgggcagaaggggcctggccttagacatgaccagggaacacaaaggaggcaggagcagccagtcgcccctgccaaatcagcaggagaagcagaaagtcaatgcaggcatgcctgctgctggtggaaccagggcctggcccaaaccttctgaagcacaaacagcattgggcccaggcagttactaaaactccccatcctgctataaggaactatagctctgtggaaaaatggccgattccaggactgagacacggagaaaacaagaaaagatgagcctgaacacatacctgaaccagaaagcaagaaagtgctcacagaatgatggggcggcatctaaaggtgcctggagcgcccccaactggccacacatggcacagtctgggcattaaggaataatgagccatgcgcttgggattagtaaactacatacatcttacagctcaataaaaaattttaaaaagacaatcgcccagacatttaggggaagaagtaatgccaattctacacaaactcttctggaaaactgaagaggagagaacacttcgaaactcatcctataaggctggcaaaaaccctgatacccaaaccagatattacatgaaaactatagaccacagtttatcatgaacatagaccaaaaaattcttaagattttagcaaatcaaatccagcatacataaaaaggatactacagcacgacccagtaggatggaattcaagtgactgtaattcactgtagtaatagaaaatgattcaccacgtgatcatctcaagagctgccgaaaagggaactgccaaaatccaacatccattcttgataaaaacacaccaatcctggagcagatggacactgcctgccttctggggaagggggccttgcactgctaggagaaatttttgccacattaaacctgcttctaatcaggcttctaccagcagtccagtgtacaggaaacccagagagtggagaagcaggttaaatgcaagaggaagcatttcgtctgatagatcaagagcagggcattctataaaattagaatgccctggactctacaaaaaagtcaatgccacaataaatgttggggactgtttcagaagcaaagagaccaaagtaaccaattgtagtacatgaacttggactggatccttacttataaagcaacaatttgccacaagttaggtaccatgatgtggccgtgcactgaaagtcaggagacacccggaacagttaatttctcagggggctaccttctgcagctgtgtaggagaccagttttgttctagagcacttgctcccaatccaaggccaaggttgaccccaccacccaggttgtctggaggcattcttggttttcaggactagggagggtacccctgccatcctgcaatgcgcaagacagcatctcaccaaaaagacttacccagccacaaatgtcagcatggctgggttgaaaatcctggtctccaggaatgctgaagactcttggtgaatgctatgctgtcacatgtatatattttgggatgtcaagaactagagcaaaacgttaactattgaactttagtgaagagcacaagcgtatgcactatactatcttttcagcttttctaaatgttttaacttctaaaataagaagtttgggaaaaataacaaaggtggaaactgatggtgcagggggacctgccctatataatttgcaggaaagggctcccaagcccaccaagcaggcctggctcaagtgggaagctcttcgggtttgggagggcgccacaggagacagtgcttaggaatttgatgtgcaactggaatgaggccctgcgaggcctgagagggaactgaccctgaaagacgcttgctgcacaactgtcaacagacttccaactactgaggggcaatgctgctgcagtcagcgccaccaccagagtctgcctgcaggccaatcaggcaccgaggcctagggccatcctgtctggaagcgcgtggggcacagggaagcccgaacagggagtttctgctaagaaggtgggtgctgcgcaactgaaaacaaaactggttggacccactgatcaccaaaaaggcgctgtctcagtctctgcgcccgttgattttgtcaatcttagagacctcttccgaacacttccaaggaaggagctgatctgcacagataccaagagctgcccggaggcgccgacccggaggaggcggcacctcatcccgctgcccccgcgcacctcggtgctcgttctgtaggcgcaggcgctggttgtacaggctcttttcggtgaggtgctggatctccagtagcccctgcacgatttcgaacacggtgccgtcgagaagcgccagggccaggtcgctgagcgtggtgtaggacaggcgctgctggaaagagctgcgggtaggggggcgcggtgagccccggcgggaaacgaagccgcctccgcaggcctccgcccgccccgcctgcgtacctgggcaactccttcaccaggctctgtagcgccgacagcaactggtagtgtcgctcctgctgccgggcaccgtccgccacctcctccaaggcggccgcgtagcgctccatggcgcggacgcccgctagccgccggcggcggcgacgagctcccccagcttcacgacatcccgagcgcggcgcgtcccgccccttttacgattgtcccacgcgcggcgcgctccgcccccttttacgacagtcccgagagggcctggccgcctgccccgccctgccccgcgccccgccgcctgcttattcaggaggcgcgccccgctcctctgcggagactccaaggagggttttgctcagcccaggctcgcacctgcctgctccccgcgcgacattaaaggcgagactccgccgtctggatatcgcaggaccacggagaatcccaccggcccttgctgagtcattgcgggccgaggtccgggctccgcgccggcgcgcctgcgaggtggactgtcccggtcaccggcctccccagaggcaggggtctcgggccagagcccacaggacctgggtctaaggcaccatccgcggccgagcagtggcgctggggtctgtctgcgtcctccccgcccccggggtgagacagacaggaccgccctagagcctctgggtcaggacagtcggagccagagtccccatctgggcctccgtggcccccagcccgtgagcccagactgcgctctccccgctccacaggccagctgctgggccggggctggggggcttctggtggctggggctgaaccgtctaggaacaggctttaataggaggggctcgggtggaggaatggctcctgcaaaggccctgccagagtcaggtcaggtgggtgggcgagaggaccagtgtggccaggctgcggaagccagcacaggagacaagggcgggtgctgtgcattacagaggctgctgggggcttgtccatagagcagcagggggcacggaagggcttggggacgcagacacgatcagacttgcatttcatcaggcactctttagctgcctgctgggtggctgggctgtgtgagatgaccctgctttgaccaggttaggaattatgactggtttccagagagaacattggttagtaattggctatggggaagagggggcgttgagccaaccaactggggtccccctgaagtgccagcaaagtgtctggttttctccaggatctgtttcctcagtccctggcaggattggctcccctgcacgccatgtccttgtggtcccttccagacagaaaccaggcatgaataaagtgaataatgacaagcgctcaggccactgccgtggagggcggtccacaacccagagctggtcatgcgccgggcaccctggcctccaggtccctcagaatggcaggagctggaggtgggactcgagattgtgggagctgagtctgtagtgagtgaccaggagccagctggggctgggcttggtcactgtcacctcccccggaggtggtgagtgggatgattagctgggtgaagacgcctgcctgtttcaccagtgtccctgccctcagtcccccagtccatgaagagtgtctgtgtggagactgggaggatatagggcagccccacgtgatgatatgtctgtggccagctgggcaacactgtcgccagctccggggtctgccaggtggggtgggggctgtgagccacagcaggagcaggccaggcctgggtttggacacctgctcctctgccttgtccgggtgctgatgcaggaaggccccttctccaacccttggtgcaacgtctgacctgaaccagcttccccagcccagcaacactgctcccctaatgtggatgtcaacctaaagaaacaaactgaaccacagttcatatagagagtttgtctgggccaaggctgagagagctgcccaggacacaccaagttgccctgggagtgcttcattcagccttattacaagcaagtttttaaagactgaaggggacaaggagtgggctgatatgaagtcagcaggaattctgactgctttccagagagaacccttagtgactggctataaggtgttggactactgggtaagagttatggtgtccagcgtatggctttttatgcctacttggtgtcagtctggaacccacagagcaattggcttcaagaggtcgttagctcaagtaggagtgggatgtgactgctgtttcattccagtgcctctctgggccagataattaaagggagctcacattcctcagataaaaaagttcctttcgcattaggagaaatacgtaatgtagatgataggttcatgggcacagcaaaccaccatggcacgtgtatacctatgtaacaaacctgcacgttctgcacatgtaccccagaacttaaaagaatatatatatgaatatatatatatactttatacatatatatataaacttccattgtgcgcgcgcgcacacacacacacacacacacacacacacaaagttccttttctttttcatggacatgagcagtatgtcactcaggcatggggactcctgggccacctctgggtcttcagggagggcctggtctggaaggaggggtctcatcctccagagccccagggatgggtgatatatgtgtaggaatgggggagctggttcgcagacgtgcgtttcccctgtgtgtgtggacacgatgggccccatggctcttcccgtcgggtggtatccaccgaaggcctttgctctgcggccactgtccacctccacttggcctcccgagtccaccaggctggctggtgacaccttgggttagtgtggggtgactggtgtgtgttggggagctgcaggtcccctgtctctgacacagctgtgtctgggcaaacaccaaggtttgaaggagtgggtgcctgtgtgtgtgtgtgtgtgtgtgtgtgtgtgtgtgcgcgcacgtgtgtcaaaaggctttgctgcatgccttttgtgtggctctttgtcacatgtgcctttctgtgtttctctgtgagttttcatgtgtcaggttgtatgtctgttgtgtgggcggagaaacagctctgctgtggggccctgagccattgcaggatccccataggccatgcagaggtgcacacagcacctgacctaagcctgctcctcccagaacatcaggctgcacccaggccaccgctcactccgtctgtctcccgagactgttcctcacttcctgcctcactggccctggtgagggtgaggctccctgcccccggccctcaaaacagagctgcagatgaggacgccacccagctgcagtgtcaaggggctcctccacagtgggtgtcccgcaacgcatgctctctgaccccttttgtttcagtgttgtcctttttagtgtgtggcaccaggacagcagggagctgccacctcaggcttctcttattttcactctgtgagtaataaggtctgaatgagaggggctcattgtgtctttactgtcaaatcagtcaggccttggccttggcatgtcttgcgtgtgcttgacaaatgtattgctcatggggtctggtggaggcacagcacccttttagaagacagggtctgtgcggaccagttacgggtgacatttcctaggcacagctcttgcctaagtggtgtgggatgggaggagggcggggcttcccactgtcccaccagcaaaatgggctgtgtggccagctcctcaggacccgagagcatttgctccaggttgataaaatgttgcggtgttgggtggcaagagtaggattgaaaccagccacccagttggtgctttgttaccatcagaagtgtttgctgagtcaaagcaaatggccactcaaaactgagtgggctgagtgtggtgactcacacctgtaatcccagcactttgggaggccaagatgggcagatggcttgaggccaggagttcaagaccagcctgggcaacagggtgagagcctgtctctacaaaaagtttaaaaaattcgctggcatagtggcatgtgcctgaagtcccagctacttgccacttgggagactgaggtgggatcacttgagcccaggaggtccaggctgcagtgagctgagatcacaccactgtactgcagcctgggcaacagaacaagaatcaaataataaataagtaagtaagtgagtaaatccatccatccaccccagagtgagtcagctggggctgctgcattgctcctccctcacccacaggattccctggttccagccaggagacgatggtcaacagccactgctgtagtggtgcctagttaaaactctttggtttctgtctctgtaaaaaaaagtgtctaattgcatttgggcaaaaaacttgcagtgaagagagaaaaagagatgaaagcaacctgtgagggaggctcgggttgacgtgcggcatgtgctgtttgagtgtgatgagtgtgtcggtttgcactgtagatgctcaggaagtgaggatatgtggagtgctgactgtatacatgatgcctccactggctggctgagtagagtttcatgaaacaatgttggtggactcagccctgaatccctcaggcattcagagagcaacctctgtcttttttttttttttttttttttttgagatggaggctcgctctgttgcccaggctggagtgcagtggtgcaatctcggctcgctgcaacctctgccttccgggttcaaatgtcctggctttaatttcacagattctttcttctgtttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggagtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctgtcttaaatcaattattttgaattgtcagacaatttgtagatctctatttttggggggttgattacaggagatttatgagtttattttggtagtgtcatatttgctgattcttcatgatctacagactttcattaatgtctatgaagaagcaaatacctcttcttttttttttttttttttttttgagacagagtcttgctctgtcactcagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggcctgctatcaaggcataggttagtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagacgggcaaagcaagactggaatggagtcacagggctactttagtgtccatagctgacactgagatcagcaggcctgttaccaagggcatgtaaaggcatcactgaattcctgggcaggcaagactgactgtggtagagtggggctgaagccaggtcagggctgctttagtttctgcagtcaggaccatggttagaaggcctgttactgggggcataaatggtcatggttcctcctaggtgcttagtggatggggctagttgcaagaacatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaaggaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacgtctgtaatcccagagtaatttgggaggctgaggcgggtggattgcttgaagccaggagcttgacatcagcctggccaacacggtgaaaccccatctctactaaaaatacaaaaattagctgggcatggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaggtcaggagttcaagatcagccaggccaacatggtgaaaccccgtctctactaaaaacacaaaaattagctgggagtggtggtacgtgcctgtagtcccagctacccaggaggctgaggcatgagaatttcttgaacccaggaggcagaggttgcaccactgagctaacaccactgcactccagcctgggtgacagaatgagactctgtctcaaaaaacaaagaaacaacaaaaaaccacaacttatgagttgtggtgaaaggagtgctagggaggaaatttatagctataaacacattaaaaaaagaaacacctcaattcaacaacataagtttacacattaagaaactagaaaaagaagaatgaaactaaacccaaagttagcagaaggaaggaaacaatagagatcagggcagagataaatggaaaagagaatagaaaaacaataaaaaacaaaaccaaaagttggttcttcaaaaagattaataaaactgacaagactacactttgggaggccgaggcgggcggatcacgaggtcaggagatcgagaccatcccagctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaactgacaagactaaggaaaagggaaacaatctaaattacttaaaacagaaatgtatttgagaatatctttatatatttctgtctgtctgtctgtctgcctgtctatgttttagaaacaagtgtctgtctatgttttagagacaaggtctagctccatcgccctggcaacaatcagatgcaaccacaatcagtggcacaatcggctcactgcagcctcgaattcctgggctcgccactatgccagctcttttttttttttttttttttaagagacaggatcttgccatgttatccaggctgatcttgaactcctggcctcaaggaattttcccacctcggcctcccaaattgttggaattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactataagaaaataaaacaacagatcaatatgcctctgatcattgatgcaaaaactctaaaaatactagcatactgggtggggcatggtggctcatgcctgtaatcccagcactttgggaggctgaggtgggtggatcacctgaggtcaggagttcaagaccagcctgaccaacatggagaaactcttgtctctactaaaaatacaaaattagccatgtgtggtggtgcatgcctgtaacctcagctactcgggaggctgagacaagagaatcgcttgaacccgggaggtggaggttgtggtgagccgagatcatgccattgcacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagtttcacattatatgcacataccacgatttacttttccattttcctagtaatgagctttaagattatttccaatttttagctattactaataatgtttcaacaaacacctttggacatctcttctgcaaatgtgtgtgtattctcttggagaaggtttaccttgtggaatttctagtgtgtatgtgtatgtgtgtgggtatatatatatacacatatgtatatattttcaactttactatatatttccaaaaaactcttcaaagtggcagatttaaactccccttcgccgtatataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtggagtagttcttaatcattttttctactaaactattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttcttcatgcattctggcatttgattaataagccatttgttgcccaacgtcattagttctctgtatatacttttaaatatcttaaacatgtaatattcataagtaatttcacaagtagtttaagatttgagtctgtaacctaaatagatacaggattttgtgatatgctgtaatatacagatttttatttatatatggataaaaatttatatgttttttctgacagcatttattggatagtataatttttctactgacttttagtatcatatcttttattacaagtccaatgtattcagcatacctatggatctatttcttggtgcttccattttttcccattgtttaacggtgtatcactgagccaaagcaaaccattttaattattataattaaaacacatttaaatattgataggctattattgttcaaaataactttggttcttcctttccgttgattactttaatatgacttttccaatcaagttctaaaaaaatactggtggtatatttattgaaataactttaataaaattaaatgaaagatcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctgtaatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttatttttttcctacatctgctaagataatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttcttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggcgtcggcccggtgcggtggctcacgcctgtaatcccaatactttgggaggccaaggtgggccgatcacgaggtcaggagatccagaccatcctggctaacacagtgagaccccatctctactaaaaatacaaaaaattagccgtgtgtggcggcacacgcctgtagtcccagctacttgggaggctgaggcaggagaatggcgtgaacccgggaggcagagcttgcagtgagccgagatcgcgccactgcattccagcctgggcgacagagcaagactccatctcaaaaaaaaaaaaaaaaaaaaaaaaaaagagtgcaatggaaagctggtagaaaatggacattgtttaaagaccaaaacaaccacactactttgctaatccctatcagctaaagactagagaatatatgaggcatagatttacgtggtgtttgactaaggcatgcagaatataatcttgacataggctaagtttatcaacatagatacatagagattctaaagttaaagtcttagcccaagaagttagaagtggtgctcaagtttgtttgtctgacagaaactgtgaatccacactggcctgcttattttgaggttgcgttgccagagctttcctagcataataaagagaggtgcatacaaaggaataggaatagtaggaggtgggggtaaaaatatcaggtgtgatccacatgccaagccgacccccactgtgtcccacaggaagccccagaagatgtttctccaagaaattaggattcgtttgttggggagggctgctggcatgcttgaaaagtactgtgacggctgaattttgtgggcttggggagattgcaggttctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttagggatctttgatgaaggctgattctcagggagtgaactagatcagtgaccaactatttgtctttatataactgggtagtgtggatggattctaataaagggactacttacagcacagcaggaaagtcacaaagaaaccagacagaagagtgtaagtagtaaggggccaagcagtcatctgactagagacagtgccagcttgccaaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccgcaacacccaagccatggaccagcaccggttcgtgtcctgttaggaactgggcacaaagcagtagatgagtggctggccagccgagcattactgcctgagctccgcctcctgtcagatcagcagcagcattagaccctcacaggagcgcaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacatagtacattgggagaccgaggggggcggatcacctgaggtcagaagttcgagaccagcctgaccaacatggagaaactccgtctgtactaaaaatacaaaattagctgggcatgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaaacaaagaaaaaaatatatatatattacaaaatttaaagagagtggtacaccagtaaaggacacttagcatgaacagaagttgcaggactggcagttgctctgatgagtcagtgagtacttggtgagtgaatgcgaaggcctaggatattactgtacataactatagactttatatgcactgtacacttaggctacactaaatgtatttaaattttttctttctttaacaagttcatcttagcttatcatgactttataaacttttaatttttttaattttttgattctttggtaataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattttctatgataacaaggctttcttctggaagaactcgtggaagaccttcctgaagctgttttatagttaattttttttaatgagtagcagtactacactctaaaaatatgaataaaatctatagtattatacatactgttgatccttgaacagtgcaagggttaggggaccagctcctctgcagttgaaaatccatatataattctgggatatccccaaacttaacttaatatatgatatatatcatatataatatatatgatatatattacatatgatatatatcatatatattatatatgatatatattatatataatatgtatgatatatattatacacaatatgtatgatatatattatacacaatatgtatgatatatattatacacaatatgtatgatatatattatacacaatatgtatgatatatattatatacaataagtatgatatatattatatacaatatgtatgatatatattatatacaacatatgatatataatatactatatgatagagattatatacaatatatatgatagagattatatacaatatatatgatacagattatatacaatatatatgatacagattatatacaatatatatgatacagattatatacaatatatatgatagattagatactatatatgatatagattatatacaatatatgatatagattatatacaatatatatgatatagactatatactatatatgatatagattatatactatatatgatataaatggtatatcatatatgatataaatggtatatcatatatgatatatacaatatatcgtatatatgatatagatgatatatcatctataagatatagatgatatatcatctataagatatagatgatatatcatctataagatatagatgatatatcatctataagatatagatgatatatcatacctgatataggtgatatatcatatatgatatagatgataaatcatatatgatatagatgatatatatcatatatgatatagatgatatatatcatatatgatatatcatatattatataataaatgatatatattatatataataaaagctatatattacataataaatgatatatattatgtaaaatatatgatatatattatatattatatctgatatatattatatattatatattatatattttatctgatatatattatatttgatatattatatattatattatatataattatattatattatattatattatatatattttatattatattatatataattatattatattatattatatattatatataatttatgatatatataatgtattatatataatttatgatatatattatatattataaatcatatatcatatatattatgctatattatatataatatagcataatatatcatatattatataatatataatataatataatataatataatgtaatcatatataatatataatatattatattataaaatatattatattatgatatactatatattacatattacattagataatattttatataatatataatatatattatatattatactttattatattacatatataattatacattatatttcatatataatttataattatatataattatatattatattatataatattatgtataatatattattaaatataatattatatattatattaaatataatattatatattatattaaatataatattatatattatattaaatataatattatatataaggatgcaggatgtaaaaggaaattatatatatgttatatattatatatattatattatatataattatatatatatttgggggtgccctatttcctatctcataacttattttaagaagcacagcataataatgtgtggacttgggattcagtttttgaaacgacacactgagccttccatgaccttcctgtacatgtgaaagcacacctgtctgcatggcagcatttggacctcacagtgtggattgtgccttcaccctggaatgtttatgccctatcgccatggtgatgtgattagggatctgctgcccttggtcctaagtgccactatctgtgctgagtttttcaaaggtcagagcagattgaacctttgtggttccattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattcttataccaagcagagtacctttgaaatttttcttcatttaaaaaatatgtatcttggctcaagcctgtaatcccagcactttgggaggccaaggcaagaggatcacaaggtgaggagatcaagaccatcctggccaatacggtgaaaccctgtctctactaaaaatacaaaaaattagccaggcatgatggcagctggtgtagtcccagtgtgaattgggattcagtttattcccaaattcccaaaatatatatatatatataatatatattatattatatataattttatatataatatatattatattatatataattttatatatatatatttgtcggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtcttgctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactagaaatacaaaaaattagccaggcatggtggcagctggtgtagtcccagtgtgaattgggattcagtttattcagtttattcccaaattcccaaattatatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagagctttgaaaacctgtttacttgttaatgctgttttgatgtattgtgtctttgttctcccgacccatcatccagagctctctgcaggagctaagtgctcatcagttccatgatttggaaactgtctaagtttagaggcacttgtatttgttagtaaataaggcaagatgatattgtttcacaggttttagtgcagaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaacattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagcaatgctgtgtccctccacatcccctaggtgactcgaagaagccttccaaaaagcgtgtgaaaaggaagccctactctactaccaaggtaaagtagcctgtctttgcctaagatgcaaatgttgttttcttggatcctttatttttcagttgatatcagctatgggaaaattatccactacattataggtgttagataatatttccttgggggtggaggaggtgtattttaccaactgacacctgattccagaggacgtgcaaaattggcagtgtcagatagtacactgggtgctaagggatgttttcttcaggaacaagctttccactttagataagaattctgcaatttctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcagtgccatgtttcttaatttaacaaatcagaccacatactttacttacattagttcacacctcatcatcatcatgcccatatgttgtgagcttgtttactgagcccacatgccagatggagaaactaagccacataaataaatgtgccctggttcacttgctgcatagtgaagagtcaaaatgtttactcatacggtgctaatgttgaaggcctgaactacaacctctatttatcagccagtgaagagatcactattcaccatgcaagggagttccagcaccctctatgcctggaattacccacacctgcagagatcccaaacgccatccctcacataagagaacgtcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtgggggttgtagactttactcattaaatcaccaaagcaccagcccacacggccacttttccagttaattgacagtagcttgcacattcaggtttgatcagtggaagggaagttactctttgcagacccatttttgacaatcattttgcggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctctggcacagggcgtgatgaagagatggcagtttttcaggaatctctctctttagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctctataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcagatcatctgaggtcaggagttggagaccagcctggccaacatggtgaaaccccatctctactaaaaatccaaaaaaattagccgggtgtggtggcaggcgcctgtaatcccagctactcaggaggcggaggcaggagaatcgcttgaacccaggaggcagaggttgcagtgagccaagatcatgccattgcactccagcctgggtgacaagagtgaaactccatctcaaaattaataaataaataaataaataaataaataaataaaaattgagtatataatacaggaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcacattaggattctagcgtgaccttgggaagattgcctttcaaggaattgatacatttcactgaggttatcagactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtcacattttcttttaatgtagttaaaagtatttttaattttctattgagacttcttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctagtatagtcttgaaaccaaaaccagataaggtaaattaaattctgtgatattttaaaatactttaaattctgactaatgtgagttaatctcaaaatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgttacaaccacttgaattaatgctgctttcacagcatatctcttggcttgttaaaaacccgacaagaatttccgtaacattatttttaacacctatattgggtgtgaacccaccataaagtttgcccactgaaaaggtctacaatttgatgctttattaaattgatactgtgtgcacccaacaccacgatctaatttaaatatgtttccctcacccaagttctgtcttgcgcactggcagttaatccccactcccatctccagccctaagcaatactgctgtgacattccatctccataaatttcccacttgctttatagaaatggacatatatatatatttggaatctgacttccttcatttagcatactatgtttgaagttaattgacgtgttagcacgtgctggtcatgtgttttccttcatagtctgctgtgtttattcatacaaatagtgtttattcatttatcagttaatggacatttaattgttttgttattttctttgatgagtaatgtagctttgagcattcacatacagtcatgtaatgcataatgacattttggtcaaaaaaaatttttttttttctgagacccaggctggagtgcagtggcacaatctcgggtcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaacaccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatgtaacacattatttatcatttgaaccttttaaccaaagtgtgcactccgtggcattcaatatattcacagggttgcataaccaacaccactatctacacccacaattttgatgatttcttacaaaaccttgtccacaataagcaatatagcaccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttgttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcactgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatactgtgtgattaataattatgctttaattaattttaaaggatataatttcagtacttctaattctcccatcagcagttataacaaaggattagtgaataaataccatagactgttttgcctagaattgaatccaacctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatacaaaatggcatttagctatgatggcttcaggttgtagactgtatccttggggtccttgtccttggaagcaatgtcttctccttggattcagtattttgcacttgccaacctacgtggacctgagagatccaccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcatgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggtctccgtggtcacacaacccagggcagttataggttcatctccccacggacaggcatagtcatcagtgtgtcaaaagcacaaagatccccaggtgtttggctcagctcaccgatcctttttttttttttttttaacttttaagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaagcaaaggcctctgtttctcatttctttcctgttcatctccttggtcatccttcttccacaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatccttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcaacgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccagggcatcgccaacgaggacgccgcccacggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaaagaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtataccacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacatcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctctatatgacatcgctaatgacacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtcaaatgccaataaaacaattgcctctataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacgtttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtactaaaaattctaatggctcatcccatttaggggctgaaagttgcagaggtttaggaagctcacccacgatactggagcccccatctcttgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctatagtattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttacaaattattgtttacatttgaagtgttttatgaattaatatttaattgcatagatgaagattactagttataggcattttactaaccaatactcattaagcatagcatggattcatatgacatcaaggagctattttatttggtaaaacgaaaaagcacaagaatgaacgaatgcaagaactgaaacagtggagacacctagaatgacttgtctaagatctaaatcattttgttgtcttcccagcatacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaatcaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagccgttcgaagtatggcaaaatggaactttaaaacagtatcttgtcaacaaccaagaggacctgtttcacataaagcccatgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccacccaggttggtgccggactctccctgggcccccctgttctctcaccagccacatccattctccccccagaggcgctagtgactgtgcgtggctttccattcccaccatgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcagagtgtgtgatgctgtctgaatgctgagcacggccttttgcagccagtccactgtgtatgctgcccctatcggagacctccaccttaaccctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgttgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcatcgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaagcttcatcagaaaacaatgcttcattaatccgtgacaggacaagcgtcagcaaacttccaggcggctggattaggccttcatctatccatcaccttggagaggaacaaaataggtggcctgggaagataagcactatgtttctattccttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagacggttcttgctctgtcaccaggctggagtgcactggcacaataatagctcaccacagcctcgtgctcctgggctcaactgaccctcctgcctcagttttagcttcctgagtagctaggactacaggtgtgtaccaccatgcctagctataataatttttatttttttgtagagatggagtcttgctttgttgcccaggctggtcttgaagtcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagactgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagccaagaaacttacaaagtctctctgccttaacttcatccaccttttttctctccagcttctcctcggtagttaatgattataaaaatatttattggctcatgcctgtaatcccagcactttgagaggccgaggcgggcagatcacgaggtcaggagatcgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttgcaacgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaagctgaggtgggaggatcacctgtgcccgggagttcaaggctgcagtgagctatgatcacaccacagtgctccagcctgggcaacaaagcaagactccatctctaaaaataaaataaaattaaaaaaaaaagatcttcgctgtaaaagaggtacactcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcagtgagcctagatagcaccactgccctccagcctgggtgacagagcgagactccgtctcaaaaaaaaaaaaaaaaaagaaaaagaaaagaaaagttcttgtgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccatattggtcaagctggtctcgaactcctgacgtcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagcctcctgagtaactgggactacagatacttgccaccacgcagggatttttttttctattttttttgtagagacacagtttcaccatgttggccaggctggtctcgaactcctgaccttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccagggcatctcggcctcaatacctgggtgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagagattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaataaataaaacatactgaaatatgtatgggtacagttatatatctgggatttgcactgaaataatgtggggtagagggaagcaggaaagagtatacatgaaatgagcttggccataagattgttgttgaaattgaatggatactctgggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaataactctaagactgcacagttatgaaactaatagagaaggaggaaattaaataataaaactaataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagggacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaagaagttactagctagtttcggtaattcttaacatccaggaaactggatgtgaaagtttttcagagaaactaaaccaatagattatacatagagagagacttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttctttttttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccaccccccttggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcccaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctggcgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggaccgatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagtggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgggatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgcccaagacctgcaggtgctgaagcccacacacacggctcctgcttcctgggccagtgcacgtgcacacacacacacgtgcacacacacacacacacccacaaatatacccacacacaatcacacacattcacacatacccaccccccatactcacacacacatttacacacacccacacacccacactcacacactcacagtcacacacaccctcacacagcgaaacacaatcacacacattcacacccacccacaccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactgacacataatctctcacacacacacatgctcacacacacacgccttctccaggaggggctggctgccaaaggccacccagcttcctcccacgtctcactcaccgtacaatatttgagaagaccttggagtcagcagcaacagcggcgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggccccacctaccgcccgccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggctttccagtctgcacagaggacagggggtcttgacagcatcaaattctggtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtgtacacctggagtctgggcccctccatctgggcagcagagaaactgaggcacagagacagactgtgtccttacagggcacacagcctgccaggcccctatgtccggccagagcccctggtcagcctgggctgcagtgattgtttagaggtaggctgttcccacggctgcctctcacggtaggggggcctgtggacgcctcctcccgcccccacccgactcccaagcctcagtgacattgctcaaccaggagctgaagtgcattcctgggctccggccagcccacccacccacccgctgcagtcctggaagcccagaggcctgggcagcaggaacagtggagacagcagtgtgggggacgtccccctcctctccccaccatcctcgtcaggcagaggccagggtgcagggaccaccggagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgctgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttgtctctgtgtctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctgtggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcaatcagtagccagcaggttccccgcctttcctggagtccgaggcagctgcccagccaccagccgtgcggacgatggcttgcaccacagcgatgaaggtggatgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggctctcatgtcacaggggctccagatggcccaggcactagagagaggacaccaaccattgtccactctgtgatgatccaggcctccagcccaggatgccctgggaccccacaccgtgactcagtttctccaacccctggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccagacctccaccccatacctggctggatgaaattggcaggtgaggggggtgccccaaactcattggtgaatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggagggtggggagggggcacaggtctcagaaggcccttgactgtgactctgaccgcaaccctctggcacccacaaccttccgtggctccccaggacccaagggcaggcccaagaccttgcatgaccagtctgactccctgtctctgtcgcgttccagcaactctgaatgtctgtctgcctggtcctcagcctccagacccttgccgcattcaatcactcattctttcatgcaaaaaatatttctacaatttgcactgcatgcctggcactggggaatcaacagggaacagacacttaggtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaagacctcctaggtcccataacaactggcttttgctctgtgccatgcaggcttaggacagaggaatgagcaggctggggagtgttttcacagggtccctctggcagctatgacggggataaggataaagcccaaaggggaggctgtgggtatcaaccaggcaagagatgatggcctgggtgggagaaagagaagaagcctgtgcgttctgtccatgtgatgaggtgggctcctctcaatcttcacacagcacagctgagcctcaaacccagcactcaccctgacctctcacctccccacaaggtaggaaaacctgttgcccaggctggagtgcagtggcacgatcccggctcactacaacctctgcctcctgggttcaagcgattctcctgcctcggcctcccaagtagctgggactataggcgcccaccaccacgcctggctaatttttgtatttttaatagagacagggtttcactgtgttggccaggctggtcttgaactcctgacctcgggatccacccacctcggcctcccaaagtgctgggattacaggagtgagccaccgcatccagcccctatttctttttaagacacggtcatgattcattgcccaggctggagtgcagtggcacgatcacggctcacttcagcctcacactcctgggctcaagcaatcttcctgcctcaacctcttgagtagctgggactataggaatgccgcaccacacctggctaatttaaattttttttttttttttttgtagaggtctcactatattgcctaggctggtcttgaactcttgggttcaagcagtcctcccacctcagactcccaaagtgttgggattacagttgtgagcaaccatgcccaaccagattttatttttatttttatttttgagacagggtctcactgtatcacccaggctagagtacagtggtatgttcacggctcactgcagccttggcttcctgggctaagtaatcctcccactttagcctccctagtagctgggaccacaggcacacaccaccatgcccagctttttatgtttttatttttttattttttgtagagatgaagttttgccatgttgctcaggctggtctgaaactcctgggctcaagcgatctgcctgcctcagcctcccaaaatgtggggatttcaggggtgagtcaccacacctggcccagattttattatttaagttaacattttgttaccattgcttaaagccacctggtccttttcatcagatagtttcttacagccaggcacagtggctcacacctgtaatcccagcactctgggaggctgagacaggtgaattgcttgagccctggagtctgagaccagcctaggcaacacagtgcaaccatgtctctactaaaagttttggtctcgatctactgaccccgtgatccgcccgccttggccttccaaagtgctgggattacaggcgtgagccaccgcgccggcctaaatattttttttttaattagctgggtgtgattgaggctgggcactgtggctcacgcctgtaatcctagcactctgggaggcaggtggattgcctgagctcaggagttcaaggccagcctgggcaacatggcgaatcctcgtctctactaaaaatacaaaaaaaaaaaaaaaaaaaaaaaaaaaattggccaggtgcagtggctcacgcctgtaatcccagcactttgggaggccaaggcgggtggattacctgaggtcaagagttcaagaccagcctggccaacatggtgaaaccctatctctactaaaaaatacaaaaattagctgggtggtggcgggtgcctgtaatactgggtactcgggaggctgagacaggagaattgcttgaacccaggaggtagaggttgcagtgaaccgagatcacgccattgcactccagcctgggcaacaagagcgaaactccgtctcaaaaaaaattagctgggtatggtggcatgtgcctgtaatcccagctgctttgggggctgaggcatgagaattgcttgaaccggaaggcagaggttgcagtgagccaagatcgtgccactgcactccagcctgggcaacagagtaagattatccaaaaagaaaaaaaaaaattagcgggtgtggctacacctgtagtcccagctatgtgggaggctgaagtaggaggatcgcttgagtccaggtggtggaggctgcagtgagctatgattgtgtgaccgcactccagcctgggtgacagagccagaccctgtctcaaaaagaaaagggtcatgatgcctccccaacaggatatggtggggacgctccaagaccatgggagaagaggatacgagccggagctatggaagaagtgaacacgtaagactccagaggcaaactgcccgtctagacagctctggcctgcagagcccaccactcccaggccagcgccgtgaggtcctgttgagccacccacctcactgtgatcatccccaggtaaaccctcggacgtgggcccggtgccctccttgctgaggctgaagccacgtggccatgaaaacctgagcatcacaagccgctctctgcgtttgtggtgtgatcagggccttctaccacaagccatgtgcccaggctgatcctctctaatgtggagaggcggctgcgctggaaaggcctcagtaagagcagctgggcccttgcagacagacatcacggtgtgaccctcgggactggctccctgcggccactgcagcacaggtgttcacatctcacagtggaggcagtggagaccatgctcgcctgcaggctctcggcgaggctctgagtctggccccttgcgtagcccctggtgactccttggcttctggagcggaactccatccttcacatggcgctttcctcgagggcctgtgtgcgtgtcatctgtggccaagttcccacttcataaggacatcagtcatattggatggggtcccaccctgctccaatgagaccccatcttttttttttttttttttttgagacagagtcttgctctgtggcccaggagggagtgcagtggcacgatcttggctcactgcaagctccgcctcctgggttcacgccattcccctgcctcaacctcccaaggagctgggactacaggcgctcgccactgcacccggctaattttttgtattgttagtggagacggggtttcactgtgttagccaggatggtcttgatctcctgaccttgtgatccaccctcctcggcctcccaaagtgctgggattacaggcatgagccaccgcgcccggctgagaccccatcttaatcacacctgcagtgaccctgttttcaagttaaggccacattctgaggtattgaaaattaggactccaatatgaattcggggggacccaatttaacctgtaatatgtatatcccaaatgcaattttctccttttttcttttagacagttgctctgtcacccaggctggagtgtagctcttggctcactgcctctgcttcccgggctcccgcaatcctccacctcagcctcctgagtagctgggaccacaggcgcacaccaccacacccagctaatttttgtatttttgagagagatgaggttatgccatgttgcccagactggtcttgaactcctgagctcaagagatgcactcacctcaacctcccaaagtgctgggattacaggtatgagccagcatgcctggcctccaaatgaaattttcagaaaggccttttcataatagtaacgggaaacaagtgacataggcatagccttgataaatgtgccaaaagcccatttggaaatagcacatttgtaggaggcctgaggcaagacttgtgggattggacgggaatgctctgttcctgggaccaatacctgatgatggagagtgtccattcttccctttaaaatttttattttaatattttatttttaaaaaggggtcttgctatgttgccctggctggtctggaagtcctaggatcaagtggtcctcccaccttggcctcccaaagtgctgggattacaggtgtgagccactgtgcccagcccattcttcccttttaatatatacgcttcacatacaggctttgtttttgcaactcctatcaaatcccaacaatgtatttgggagaatttgacaagacagttctaaagtttatctgaaagagaagcagcagatcctaaatggctttccccaggcccagcactggcagatagcacctttctaaccttcgggtgtgaatccaagggtggtggtggagcttcaggacacatgcaccctcgtgtccctcctctatgtaaatggaagccttcagtgccagctcctttaggttgtaaggactgaacacgctcacagaagtcgtgtgcacagtgaggtgggggctgaaatgcagcagctcctctccctgtgttctgtccccgccccacctctcccccacctcaactttgaccactaggggaccaattataacatgagatggcaagaatagctcatgtaaagccaccccaccccagtcacctggttgctgcatagtgtcacattcataggagtacaatttagtcactagtaatcctttgcgaataatacaaacgtccagtaattctttgctgcataacaggccttgtgctcaaaaggttctgcagaccttgcctgggtgctctggccaagctgcagtcatcccagggctggctgggggctgggggtttgccggcatgcctgctggttggtgctgctgccagtcccagctactcgggaggcggaggtacggggacggcttggtctcaggaggttaaggccgcagtgagccatgatcgtgctattgcactctggcctgggcaaccaagcaagactctgtctcagaaaaaaaaaaaaaataagggggtgagaggggctataaaggctctgaggtccacgctctggaggcccacaaagtcttttctgcatcatcttgtttgtcagagcaagacccaagggtgagcctagattcctgagctggggaaacaggctccacctactggtggtgagaactgtagacaatctgtggtcgttttgagtccactataagtaaccaaaataccttcagtcttgcttgcatttctcaacattagtgaaaggggacccagtgcttggttgtagcaggcgtcctaaactctccttctgacctgcagagttttcatctgcagaatgtcccctcctggtgcacagcattcatgtcccttgtcctcatccctggtgggtgctctcgccgcctcctttctgatcccatcctcctccttgtcctaccaaccgtctgtactcaccctgtgtatttagtttatataaatgttaatgcctggccagccgtggtggctcacgcctgtaatcccagcactctgggaggctgaggcgggcggatcacctgaggtcagaagttcgagaccagcctggccaacatggtgaaaccccgtttctactaaaaatacaaaaaattagctgggcatggtggcgagtgcctgtaatcccaactactcgggagactgaggcaggagaattgcttgaaccctggaggcggaggttgcggtgagctgagatcataccattgcactccagcttgggccacaagagtgaaactctgtctcaaaaataaaaaaattaaaaataaatgttaacacctgtagtcccagtgctttgggaggtcaaggcaggaggatcactttagcacaggaggtcgaggctgcagtgagctgggatggcgctactgctcctcagcccgggcaacagagtgagactcgatctcaaaaaaaaaaaaaaaaaaaaagaccagcgggggtggttcatgcctgtaatcccagcattttgggaggccaaggtgagtggatcacttgagcccaggagtttgagaccagcctggtcaacatagtgagacttcatttctacaaaaaaataatcagccatgctgtagtcccagctactgggggtgctgaggtgggaggattccttgagcccaggatttcaagaccgcagtgagctaggatcaagccactgaagttcagcctgggtgacagagcaagatcctttctctctaacaaaaaattaaaattaaaaaatattggccaggtgtggtggctcacgcctgtaatcccagtaactttgggaggctgaggcaggtggatcattcgaggtcaggagttcgagaccagcctgaccaacataatgaaaccctatctctactgaaaatacaaggattagccagacgtggtggtgggcgtctgtagtccagctacttgagaggctgaggcaggagaatcacttgaaccaccacgcccaacctaatttttttgttgttgttgttgttagtagaggcagggtttcaccatgttggccaggctcatcttgaactcctgacctcaagtgatccacctgcctcagcctcccaaagtgctgggattacaggtgtgagccaccgcgcccgatctgaagacatttttgattggttgattgagttgggggtctcactgttgcccaggctggagtgtggtggcatgattatagctcactgcagccttaaactcccaagcccaagagatcctcccagctcagccttctgagtaaccgggactacaggtgcacaccagcacacccagctcattttaaattttttctttttttttgagatggatcttgctctgtcacccaggctggagtgcagtggcgcaagctccgctcactgcaagctccgcctcccgggtttatgccattatccagcctcagcctcccgagtagctgggactataggcacccgccaccacgcccggctaattttttgtatttttagtagagacggggtttcaccgtgttagccaggatggcctcgatcaggagatcgtccatcttggccttccaaagtgccgggattgcaggcgtgagccaccgcgcccggccccgtagtttcttacatgttcacaaagagacaaacttaaaagagcaaagcattacgaactttaagaggccagtgcaggaggatcacttgtagctagaattttgagaccatccagggcaacaaagtgagactctgtccctacaaaaaaaattttttttttttttttttttgagacagactctcgctctgtcgcccaggctagagtgcagtggcgtgatcttggctcattgcaacctccgcctcccgggttcacgccattctcctgcctcagcctcccgggtagctgggattacaggcactcgcgaccatgcccagctaattttgtatttttagtagaaatggggtttcaccgtgttagccaggatggtcttgatctcctgacctcgtgatctgccctcctttgcctcccaaagtgctgggattacaggcatgaaccaccgtggccagcctcttttactatttttttttttttttttttaagatggaggctcacactgttgcccaggctggagtgcggtggcacgatctcggctcactgcaacctccgcctcctggttttatgcgattctcctgcctcagcctcctgagtagctgggattataggccaccatgcccagctaattttttgtatttttagtagaggtggggttttaccatgttggccaggctggtctcaaactccagacctcaggtgatccacccaccttggcctcccaaagtgctgggattacaggtgtgaaccactgtgcttggcctttactactacatttttttttttttttgagatggagcctccctctgtcaccaggctggagtgcagtggtgcaatctcggctcactgtaacctctgcctctcgggttcgattcccctgcctcggcctcccgagtagctgggactacaggcaagcaccaccatacccggctaacttttttttttgtatttttagtaaagacaagatttcaccatcttggccaagctggtcttgaactcctgatctcatgatccacccgcctcggcctcccaaagtgctgggattacaggcgtgagccaccgtgcccggccgtctactacttcttaaagggtgagaggcggaaggatcacttgagccctgaagtgtgcgactgcagttagcttttatcgtaccactgcactccagccagggtgacagcaggaccctgactctaaaaaaaaaaaaaaaaagcaaaaaaaagcatatactattaatacttcctccttactataatgtttactgtggcctttatcagactagagagtgcttttatctctcccttttgttagagcttttagaattatcaatagatggtcaggtgaggtggctcaggcctgtaatcccagcactttgggaggccgaggtgggtggatcacgaggtcaggagttgaagaccagcttggccaagatggtgaaaccctgtctctactaaaaatacaaaaaaattagctgggcgtggtggcgagtgcctgtaatgccagctactctggaggctggggcagagaattgcttgaacccagtaggcggaggttgcagtgagccaagattgtgccactgcactccagcctgggcaacagaatgagactctgtctcagaaaaaaaaaaaattattaatagatggtgaccctcatcttcatgttttctgcatctattgaagtgcgccattgagatcgtggagttcttccctgtttgtccatatggtgaacaacactgattttctgatgttgaacaatctctggaataaactctgtttggtttccatggatttctgtttccctttagattttgttagtaatgtattttggatttttgcatccaagttcataattgtaactggacaaataaaggcagattttaaaaggacaagttgggaggctaaggcggaaggatcacttgagcctgggagattgaagctgcagctagcctcgattgctccactgtactccagcctggtgacagcaggacctgcctctaaaataataatacttaaaaggacgagtttacctacagtctcaccaagcaatgaaagagcttatcttcctcctgtttcctttacggatcttgctcatgtattttatcttagttactttagcataaatgctaaatcaaattctttttcactagacatcatcatagctctaggcataccacataatacccaagcacattttaatcattaaaattgtttcctttttttgtggctactgtaaccacttcagcgaaccatttagtgtgtagtgggtttaaattattttttctcctttctgggataaatttcccaggagaaggataattgggtcaaaagctacgaacatatttatgggttcttttccacaagagatcgatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggaggtgcgcggggaacgccgctcttctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctacggaggggaaccgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcgggggatgtgggcggagcacaatcgcatgggggcggggctctgagggctagaataggggcggagcgcggagggggcgtggccatgaccagttggggcgttgcttacgactggtcctgaggacgcgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgacgccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccatattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccaccttggcctccccaaagtgctgggattacaggcatgagccaccgtgcctggccaacattttctccagatatcttactgagtcctaatttccactgtggccagagaatacactctgcatgattttaattctatctcatttactgagacttgttttgtggcccagcacaaagcttgtaatgaacactgagaagaaagtgtattgttgctgttgacagagtgattttttttttttgagacggagtctcgctctgtcgccaggctggagtacagtggtgtgcaatctcggctcactccaacctccacctactaggttcaagtgattgtcctgcctcagcctcctgagtagctgggactacagatgcattccaccatgcccagctaatttttgtatttttagcagagacagggtttcaccgtgttggccaggatggtcttgatctcttgacattgtgatccgcctggcttggcctcccgaagtgctgggattacaggcatgagccaccgtgccaggccgacagagtgtgttctaaatacccagcaggtccaggtgagtgacaggcttgttcagggctcctgtgtttactttcttgttggtagcgccgtcaattgcttattgtgaaatgccccttcataaacacccatacacattttgattatggatggccagtcttttttctatctgttattttcatcttacatctgtcttcatatgtaaagtgctttggttataatcagcacataactgggtctcacttcttcaattcatgtttgtaatccctgacttttaaattgggctggtaagtctattatgtttctccttttctgccttcttttggattagtatcttttaaaactccttttaacttatacgctgactcatattttttattaagacagtctcactctgtcatccagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtgtttttcaactctggaaatcccattagaagttgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagacaggttgcagtgagcagagatcacgccactgcactccagcctgggcgacagagtgagactccgactaaaaaaaaaagaaaaagttgactggagcttttcattcaactcttctttttttttttttttttgaccgttacccaggctggactgcagtggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttgaaaacaagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattatgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataaaacaggtagggaatatgtccagtgcaaacagaggactcacacctgtgcatagacagcaccatccactgattgtcgctgcagtccacggcgttactaagcctgcgccacccacgtgctgccccaggaggcgctaccaggctcttcgggccacaggcctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgaaaggccaagaagagtgaagggagattcgaggagccagcagggtctggggtccctccctgcagggagccctacctgtccaatcagccccttatggctgcccagcacctgaaggtacaaatgtcccaggcgtgccctcccccacccagtgaccacatctgctccaacccgggggactctgaggccacctcatgctcctcagccaaaccgcttccatccgtgggagccactgctctgccccatgggcctcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgacggacctgggcgccacctgggggcaggtctcagcttcctctcacgctcctccggcagttccccatgcagatggccacacctgggcccctcctcctagtctggatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagttcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctggagaagaggctgtgtcagggctgccatgggcagggccgtgctggctccctggcccagtgggaggagggtcttccatggggacggacttcagctgagagccatgccctggaaatgtacctttggggtccacatgttggaagatggggtgctgtgaaggccacacctggcctatcatgggccctgtccccttcccagcatcacctgagtggccccatggcattaggggactaagcattggggagctaagctactgcagccccagaccttagggtggaggtggggtgggcgtagcatccttgacataaatagaggcccctgggtgggtctctggtgtggccggcacaagcaggggcccctcacagttgtggtctaggggtagagcctcacctaggaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagaacttgattgtctggccgcgaaaacagggcaggcccgtgtccaacatgatagtgaccagggagacgaccacatccatgtagggcctggggagagacaggagggagcggtgggcagaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggattgtggggaaggtggttggaattagatgcccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggtcctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactctgcaacaggagcaccccctccacccccaaaaggcaggttgtgttttcttggagacagtgatggggtgggtggtggggcagcaggcagagaaagagaagggaggaagtggaggaaggagccaagctggggcactgaacctggacgagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcaggcctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgtttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcgggatggtctcgatctcttgacctcatgatctgcccgccttggcctcccaaagtgctggcattacaggcgtgagcactgcgcccggccaggtgccctggttttttttttttttttttttttcagatggagtctcactctgttgcccaggctggagtgcagtggtgcaatctcggctcacagcaacctctgcctcctgggttcaagcgattctcctgcctcagcttcctgagtagctgggactgcaggcgcgtgccactatgcccagctaatttttgtatttttagtagagacagcgttcaccattttggccaggatggttttgatctcttgacctcgtgatctgcccgcctcggcctcccaaagtgctaggattacaggcgtgagccaccgtgcccagcccaggtgccctggttttaacccttaacaaaggatgactgaggagagcagggtgtgggtagaggctgggtatgggtggctggggtagggtggagcgcacacgactttccccggcctgtggccaccctggctacctgctggaaggccagagtggactcatccccgtactggcgtgtgaagtagtcgtacatgccaaagtctgtctggcggcccagctggtcccgggaggtgcagtcggggatgcactcgatcaccccgcactaggaggaaaggccagttctgaggcccgccgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagtagctcttctggctcatgcagggcaaaagccgagaacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcagggacagtgggaaaggggctggaaggagaggcctctgggttttgcagaagccctaatttaccccgtggcacctgaaccatgtaagagaaggaaaagattcacatttctgcatatgagattggactctggtgggcctggagccttggggagcagcaagcccagtccccaagcctacttgaggcctgaccctgcttacctgccggcagtcgtctcccagtttgaagatggctgcctgccaggagatcttctggccgtcggcctcctgcgtgctgcactcatcctcagagtctgagcggcaccgcagacctgcccgcagggagagaggccactgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgagtcagtgttgggtgctgtgagctggggggcaggaggaatgtgtctgtacactggggtcctgggagggctcggggccagtgtgcagacatggccatgggaggcaggtccctgcaaggggtggcagccccctctccacagctggccacaccgtctgtactgggttgaagagtgtctccctaaaattcatgttcaccccaaaccttagaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggtgagcccaggactgctggcaacaccaccagaagctgaggaggcaaggtgtgacctgcccagagccttcagagggggcacgaccctgatgatggactccagcctccagaactgagatcgtccgtacagtagccccaggaaactaacaccccccaacggccccgggcccctcagcctcaggaaggagcctgctggagcatgccagctgactcatggcagacagacctctggggtggcacatctgtcagtgcatttgagctccctgccatcccctagcgaggggtctgactgagggcagacagatggacagacatcatcttttatggagagctgtactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcacacgcggacgctgtggaagcgggggatgggtagggtgaggcgctcacctctacatcggggtcccagacttgtagtcgacgtccagcacaatggcttcagggttgctgggcagggagcagcctgtgcagggacagaggcagtcacagggagtgcatgtgtcaccacaggtgagccagagtcagtttccaacacggatgttacgtgcgtgtccaccctgcaggcacaccccacccctgtggaggggcctctggtccttgtccagggcaccactaacttattattctgtggccgctaagggtccgtcctccttgactcttcgactcttccaaccatcgaccaaatgagtctgcaccttctgggaaatgctcttcctagaggagcactgagccccatcctcacggatacagccctactgcttctgggggtgtgtgtgaggcctgtcctgcctccacctgcctgagcaacagcctctgaacagccctccattcttggagtccctgtttttttttttttttttttttttttggatagagtctcactctatcacccaggctggagtgcagtggtgcgatcttggctcactgcaacctccgcctcccaggttcaagcaattcttctgcctcagcctcctgagtagctgggattataggtgcctgccaccatgcctggctaatttttatatttttagtagagatggagtttcgccatgttggccaggctggtctcaaactcctgacctcaagtgatccacccgtcttggtctcccaagtgctgggattacaggtgtgagccaccacgcccggccttccttacccatttgaacactactctctcaaaagccttacttaaatgtcactatgtccatgaactgtccttggttctcccagcctttaggacttttgtctaacacgtttctttttttctttttctttttgagacggagtcctactctgtcgcccaggctggagtgcagtggctcggtctcggctcactgcaacctacgcctcccaggttcaagcgattctcctgcctcagcctcccgagtagctggaattacaggcgcccgccaccgcgcctggctaatttgtgtacttttagttgagatggggtttcaccaagttggccaggctggtctggaactccttacctcaggtgatccacccgccttggcctcccaaagtgctgggattaaggcatgagccaccgtgccaggccaacattgtttctttatgcttattttatatctctgtgagttcaagcttcttcagctcagggaccatgtcttactcatctttttaacagccacaatacccaatgtcatgccttttcttttcttgtttttgcttttttgagacagagtctcactctgtcacccaggctggagttcagtggtgcgatctcggctcactgcaacctccacctcctgggttcaagtgattcttgttctcagcctcccaagtagctgggattacaggcacgcgtcaccatgcctggttaattttttttttttgagaccgagtgtcgcactgtcatccaggctggagtgcagtggcgcaatcttggctcactgcaagctctgcctcccgggttcacgccattctcctgcctcagcctctcgagtagctgggactacaggcgcccgccaccacacccggctgattttttgtatttttggtagagacggggtttcaccgtgttagccaggatggtcttgatctcctgacctcaggtgatccacctgccttgacctcccaaagtgctgggattacaggcatgagccaccgcgcccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttctgcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccaatgcgggaacagaggccctgcatacatgtcctgccctctctgggaagccgtgctgttgtgtgagctcaatacaatgtgttgggaagaaatggttaaaccggggtcctgcagggcactcaaggaccagccgctgtgaacatctgcacgggacagacagagtttggaagacaagtttgtgccaatagttagaaatgcagagagaggccgggcacagtggctcatgcctgtaatcctagcactttgggaggccgaggcgagaggatcacaaggtcaggagattgaggccatcctggctaacacggtgaaaccctgactctactaaaaatacaaaaaaattagccgggtgtggtggcgggcgcctgtagtcccagctactcgggaggctgaggcgacagagcaagactccatcgcaaaaaaaaaaaaaaagaaatggagagagagctgcccagtgaagtctggatttccatcttctcttgaaaagctcggcttgaattcccatgtggccacagccacaggcacccaggagcgacttcccatggaggcggtgagggggtggtgctgatgggtcccagcacacctgagccctcccacactgggcccgccatccccttgtctgtgtgacctgctcctgtaatgctggagcctaggaaccctcttctagagtaacagctactgaggtcagtgtgagcctccagaaaaacagcaggcagcaaggaagatgaagggcacccactgacgagcagctcccgctcactagcggcagattttggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacctggctgcaccgtcacttcagacagggccgacagacaagccttctttctctggtcgcctttagggtagggcctgagaaacaggaaagaaattcttgctttgtctcctggaggaactggctactgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcttgggttagaagctgccagcactgctattctcagcacccagcccagaaaagggcctcaaagtgaccaaggtcagagcagtgtacgcaatggagacagcccagccggcgtgcccagcattgatgactccagggtttcatcccttatgaatgcacaaagccaccaacatccaaggatggtgtcaggtccacatgaatggaaggtctaggaaaacgatgacaggagctgcaaaggcagtctggttttcctgacaccaagaggatcgatccttcagagtgtggagagggcagggtgacctcaaattgtggagccatgtgctaaattccacaaatctcaggaatgaaactaagctgtgtttcctgaaactggcgtggccgtgcattctgccataccttcaagagccctgactcaccccaagcagtgcttccccacccaccctggctgtccatcagaaccaccagcagccccgctgctagagactctcattcatctggttggggccacgcacgggtatttttaaagcttcccaggcaattctgttaagctgcagggactggaacaagattccagaaggtggtttccgaagcactgcacttacttgatgacagccgacacgttggtgatcttgttaaagaaatcaaactcccgctggtaaaagtccttcgctgggcccgacaaggagcctgtgttctcctctactaactgctcccggaggtcgccgatgtcagctgccaaggaaacaaagaggctgagtctctgtggctgtggcagaggcccctcaggaataccagccctgtttcccaggccccagactggcggtgcccagagtatgctctgcaggcttggtgagaccataacagctgctgtgtgccccttttgctgtgttgacacagccgacactgctgggaagctaagctggtgcctaagcggagctcaaggtaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttttaatagaggcacacagtgggcggggctctatattaaatagtgtctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaacgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaatagcttcccttaaaaactctttctgggccgggcgcggtggctcatgcctgtaatctcagcacttcaggaggctgaggcgggcggatcagaaggtctcagccaggcaatgtggcccacacctgtaatcccagcactttaggaggccgaggtgggcggatcagaaggtctcagccaggcaatgtggcccacacctgtaatcccagcactttaggaggctgaggcgggcggatcagaaggtcaggagtttgagaccagcctggccaacatggtgaagccccgtctctactaaaaaataaaaaaattggccgggcacggtggctcatgcctgtaatcctggcaatttgggaggctgaggtgggcggatcacgaggtcaggagattgagaccatcctggctaacacagtgaaaccccatctctactaaaaatacaaaaaattagccgggtgtggtagcgagcgcctgtagtctcagctactcgggaggctgaagcaggagaatggtgtgaacccgggaggcggagcttgcagtgagcggagactgcgccactgcattccagcctgggcgacagagcgagactccgtctcaaaaaaaaaaaatttaaaaaaaagtccgggtgcggtggctcacgcctgtaataccagcactttgggaggccaaggcgggcggatcacgaggtcaggaggtcgagaccatcctggctaacacggtgaaaccccgtctctactaaaaaaatacaaaaaattaggcgggcgtggtggcgggcgcctgtagtcccagctacttgggaggctgaggcaggagaatggcatgtacccgggaggcagaggttgcagtgagccgagattgtgccactgcactccagcctgggcgacagagtgagactgtctctcaaaaaaaaaagaaagccctctctcgtctctcagtctgtgcttagtaatcagctaggcgctgagagaacagggcatggcctccttacagaggtttgctgcttctttgcgtggcatgttttcatttggcattcccttccctggaatgctctgccctgtccaccctgcatgccggtgcagcctttcagactcagctcaactgtctcttttccagaaaaccatctctgattccccaactctggatgggccaagtgtctgtaccggaggactgctcccacagttccctcaaattgaaatcacctgtccatttgactgcctcctacaagacaacaacagaccataccccagtcatgtaggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagtcaaggccagggctcaggggggtctaactgcttttccgtccctacctctggcaccctcagggctgcccacgttgcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtaggaaactttgggggacagcttcaaacaaccataagaggacaacggctgagtgtctggagtcagggactagaggccagtcacacaaagcagtgagaaggtgatgcagacaatttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtctggggcgatggagcacttggaggggctgggccgtccctggatgccgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccggtcagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacatgccggttcatgctccccttggccccaccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttggtcggggaacaggcacgtacgtcgatccagatgtagtggggggtcacttcggggggacagggtttgggttgacttgcttccgaggcagccagggggtctgcttcctttatctcagcagaaaacaggccaaatttctgctccactgtcatgtgccagcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgcattctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggctgctgagctggcaagggcagaagagggttctggatccagggcctggctcctcctctccaccccacacagaccctacccgataccttcatcccgctaaccagattaggaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtacccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccctttgcactctgtccttgtcttccttcctgctgggaggcacagaagccatctggaggctgtgagggtggagacaaaggccacataagcccaggatggccaggagccgacaggagcctggggcggggctctgtctgctgcttccctctaagctgcccatggggtgaggactcctgggggacgaggcactacagcctgctttgtgtttcctgcagaccgattagtcttatggaagcagacaagggagcaaaaaaatggcggtgggggggaccccagaactgccacggacaagaagccatcgaagagacacactcccatctatttgttaaacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtggccaggtggccagggagagccctggcaaggaggggacatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcgaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagggggcagcagctgggatgctgggacttgtcagatcctggataaacctcaaaggtgaaggtgatgggatgtgctgagagtcatcagtgggatgtgcataagagggagtcaaagatgtctgagcagagagaaggacctcgctggcatctacagtgaagggagggacctcgctggcatctacagtgaatggagggacctcgctggcatctatagtgaagggaagggtcacgctggcatctacagtaaagggagggacctagctggcatctacagtgacgggagggacctcgctcacatctacagtaaagggaggggccacactggcatctacagtaaagggaggggccccactggcatcaacagtgaagggaagaaccaccctggcatcaacagtgatggcggatgggcgaccagtgcagcggtgtctggagctgaggtcggacccattagttggggctgctaatcagttcaccatgcaggccgtgggccaagccactgaagggatccacctggactaggagtgactgggctgggtaagcagtggagctggccagagtagccaggcagggaggaggagccctggggcatgccagtactgagaaggccctgagctcaagaaggtccctttattctggaggatgaaagggctacaaaaattacaaaggccttaagtccctgggaaaagcagttaggctcccaaaacagctgctttcaagacccagaactctgaaggaggctgtgagcagctttccctgagctgatctgtcctcctaccatctgggacctgctagtgatatctgtactccaactgccctgcccccaggggtcaaccaacccactcctatctgaggacccactcctatctgaggaccagacagagaggccagaggttcaagggcacctggactaaggaagtggagaggagagagacagatctgggctccagagccccaggtacaatgtgagggctgacacgtggtcaggagcacccccagtgccctgtgaaatgggaacggctacagcccctactctttttcttttttttttgagacggagtttcgctcttgctgcccaggctggagtgcaatggtgcgatcttggctcaccgcaacctccgcctcctgggttcaagcgattctcctgcctcagcctcctaagtagctgggattacaggcacatgccaccacacccggctaattttgtatatttagtagagacagggtttctccatattggtcaggctggtctcgatctcccgacctcaggtgacccacccgcctctgcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggctttctggtgaccccagaaaacatcagtgccggctctgccagcacccagacacctggtaccccgagactggcaaggggactggaagagggcagtggcctccaggctccctccacactgcccagtgctgtgtgcacacaaaggaccacgggtcagacagatagaggccgagctgtggggctgtgtgccacccagaaactccggggaaaggggccagtggcggtcccccctcccctgcgcctcaccagagtgccaagggcccagacaccatgtgagcagcagccagcggggcgggggggcctcctgagcccgtggccttcctgggggtgcatcaatgcctggtcacctggggaagagaagacgaacacagtcacccagacagccatcagcgaagaagggagggaagggcgatgaagggacgcacctgggggtctctggctggggcaccaggggcagcccagcaggagactgtgaccacagagcctggtagttggatctgacagccaggaagagtaaggaccagcgaacaggtctagggagttcggtgggtgcaatacctgcccctctaacacaggacattaaggacacccaggggccacctaggccagggggcgctggtggcagacacacaattcttggcctgcgggtgtggtagcaggaggcctgggcagggcccttcccaagctggccacatttacataacaaaaggtcaaaattggagccacttgtgcaagggctatttataagaaccagtctcaaccgcttttggctcccccgttccttcccttcctgatctgctctcaccgcctccctgcccagagggcccagccccctagcccgcctggcctgaccacatggccttccctctccagaggtttcactgcctaagggctcacccaagctgcaggcctgggctttcaataccggcccaccaaagccttgggcagctgccgccaggaaacgaggggttccctcccacccccagagctctgggtcctgcaggaggggggatcctgaggtggtgggtccttgcaccccacacctgccagcctgggcccccacggaatagagccggggtcggggaaggggcgtgcagcggcccgtccccgtttccccttcccccactccacccccagggccagggaggctcagcaggtccctcaggaatgtgaccagacccggggtgccggcccagagctgggaggcctaggctgcagctggccagctgtctctccagcccctagtgcagctcccctctgggtggggggtgtgaggggagggggtgcatggctggtccaggaccccaccaaaggcccagagggcagcagaaccagctctgttggtaggaagcccaagggcgtccacagttagcaagggttgggcccagtgggctaatgctgggatgaggccagtagggcaggggccactgaaacactggcgggagcagtcgaaaaactgggtagagggtctcggtggcacactggaggcaatcagataccaccatccagccctgtgccacttcatctgctccccaaccactgcccctcaggacccagtcaaccatgggtagagcgcatgccaaactctgcagccaggggtcacctgaccttgccagaggccaggccagctactggatgccgcgcagggagtgggtggcagaataggactggggggcacctgagtgccatgggggtgggaacaccctccgtcagtgcccactgcctggccctgtcgggcactttacaagcccaaggctagcactaggtctccccaccaaggaaggatggccccaggctgggtcagctgtgatgtagaacagggcagggctcctccctgaaccctccacttgagttagggggtgtcagagccacctgcagaaagttcacagcaagcacaatgccaccatgcgtgccatccacaccagctgggccaagtctgggccacatctaggccgccactgtgtctgcgagcagcaatgcagcctcaccccatggcggggcagggggtggcacacgccatcctgctgcgaaacgcctactaagcactgctccttccttctcagccacagagctctgccctacccgctcaccgctggacatgaaacagcaagtgcctatcctggagggctccgcctggggagtgccaggtaactagaaacacggctctgggtgctggcccggatgctggtgctcagccctggaagcagctgactgcaggctgcgatgagaatgccacctagcacccagcagcccctggcagcaggcccgggcagcacgcctatcagcccccaggctagcacgcccagccctggcctactgcccatccagaaacgctggctcccaggacgcccaggatctgaggcagtagggcagcaggcctgggctatcggggccagctgggcattcgcctaaggctgtgacccatcccctccctaggacagagccttcaggggtccaggggagaggcaagaagggtagcacagaaactatctcccaagttaggatccctcagctccaggattccccctgtaggtggactggccccagctgggaaggacaagagccccagcagctggagggagggccagctctctctgcggaatcctgaaggtctgcaggaaggaacacaaagcctcggggttaccttcccaggccatctgttagagcagacacacggccctgtttacggaacagccaacatgccaactgctctcctttccttcccctcccagtccccgccacaaaaaagccagaaagccatgtccccagacactgagggcaggcccagggcccaggcaggtgctagcgggctggaacagcactcagatactccagcctctcaagccactggtggcacatgcccaagctctgtagaactgggccagccacagcagccccacccccgctctgttcgccctcaaagaacttacagtaaggcagctgctctgcaaggcccagtcagagcctacccggcccagcaagtccattctgtggcaagaaaaaccttggggacacacatacccaactgctaagtaagattatctctggggagcgggattacagaaaaaccatagtatctgtatattatgttcatttctgtaatactcaacattttaaaaagtattacctttttttttttttttgatggaatctcattctgtcccccaggctggagtgccatggcgatctgggctcactgcaaactctgcctcccaggttcatgccattctcctgcctcagtctcccgagtagctgggactacagccgcctgccaccacgcccggctaattttttgtatttttagtagagacggggtttcaccgtgttagccaggatggtctcgacctcctgaccttgtgatccgcctgcctcagcctcccaaagtgctgggattacaggtgtgagccaccgtgcccagccaaaagtattacttttaaaaccctaaaaatacaaagggcagaaatgatgcagagacatggatgaacctcacagtcgtggcactgagtggaagaagacttttgcgagagtacagactgcatgactccatttacatcaagttctagaataggcaaaacggactgagggtaaaaaccagagcagaacaggctgtgagcgacaggtgaggactgtccaggatggggcgagggacaagcgcccactgcctggccctgacaggcctatccaggacggggcatgaggaactctttggggtgagggcagctctctagcttgctgggaatctgggttaaggtaaatgaaaatacaattttaggcccttaattgtatgtaaactttacttccaatgaaacctccagacagaggctttcacaggacattctcatctcagaagctcagcacgataccctggaaacaccaccagctaacctttcctgggcactgttgtatgcccgaccatgtgctatgtcactggagccgcagggccacccaggagcctgtgcgttctgtccatgtgatcaggtgggctcctctcaatcttcacacagcacagctgagcctcaaacccagcactcaccctgacctctcacctccccacaaggtaggaaaacctggggctgaaagtgtgcagggacatgtcatctttagccttgggcaaaggcaacctttcccactgatgatttccagatcacccaggggtattggttctgcctcaattttccaactggcacagagatcaagggcgacggtgaagcagattggaagggcaaagacgccacggtgggaacaggttcctatccctcccggctgctctccagctgggtggccctcagtgcatctccagagggcagtcaaaagccccaggccaagaccaccctgcactctggatccctctactcgctcaccaaacacagaccagccaaataaccaacggggatggcagaggccagggcactgtgcacccctcgctgcctcctgacactcgaagcagccccccattgggggacccactagcccatgatcctacgcgagcgaggtcaggccacacctgcccgtgtgtggagcctctggtcagtccacatggctgcaggggcctgtggggaggctggaacagggttacctcaaggcctttcttctaagcacccagcaaagggcaggagagtgtgctctagtcagcatctttcaaaggccaggagagaggaggttttcagatcaaagtgatccctgctgaggcagaaagcagaaaactccagccccaattctgagaggcactgccccaacccagcctggatacccaccttgcctagaaccttggcctccaagaagccaggcattcagaactgctccaggtgctgggcctccacatggctccttctggaggccatgactctgggagacaggaacacatctcacgcccatatccaggcccacaggcgggggtcaaactcagggtcaaactcatctcagccacatgataaccctgccttcagactgaaacttctggctcacgcccagccaggagggaggcctggggagaagggtgaagaccaggaaagggcgccaccccaagcaggccatcccgcctagccctcctaggatccttctcatccaccttcctccctggaagctatcctttactaccaagaaaggggcttcctgcaggaggcctggagctatgctggaggactgaggagaagctccccccagcccactcccaaggagcagcaccttaaccacctcccagcctaaacaaaagtaacagtgaaatgagaaccctccagctaacgccaagacagctgagagtgagcagggccgcccacggcccgcccgagctccactgtcaggtgggagggacaagcatgccaggctgagaagccatgctaggcagggcagggccaccaggcaacttccacaacccagaggtctaagtacatctgaccagggtcagagagagccccagacttgctgccactgctcccaaacttcagtctaaggtcagcatcggccctggttccagaccaacccccaactatagtcacctcatacttcaggtgtggccgggacagatgcagctgcaacgggtggccctgtgtgagctcagcctcttcccaggagcccctaagccatgggagagactgcctggaaggcacaaggcagccaggcaggaggcagccagtatccagaagtgccccaaggcccagcccctggacacaccaaccagccctgcacagtcacaagcccaggactttgttcatcctatccccatggcctggagtcctccctgaggaagccttggtagacaagagatagctccaaggggcgaaggctgcacctcgcccaccgccacagccctgtatgagatggcagcctacatgtgggcaggtctgatctcctcaatcttcccacaggcccagtgagcggggcgttatctctgcagtttcagataagaaattaaaggttcttgggggttaagcaacttgcccagggtcacaagagcatgtaggtagcagagtgaggacctaaagcctgactccagtgttgtagtctgatgacccccccgcccaacgcaggcagggccagggatgccactcacacatggcttccaactgccaagctgcttgggggagctagaggaggcaccgccctccatgcactggtgtgccaggagcagggactccagtctgcacctccaccctcactcccccaccccccagcaccacctgcctatccacagcagggccccacctgggtgtattctcccaaactcactgtgagggcatggggtctgcccagctcctccaccagaagtgacaaggtggagcccccatgcagcctgctttggaggcccaggttgtgcttgctgctcctctgggaacacccccaccctccatgacctccttccctgtcccttcaggaatgggctggtggtgggtggggctcactgctctgggcaagcccagccatgtaatccagcccagacctggatgccggccagcagctcctggctctcctcccagaccatcctcctggaaagcaacaggctccacaaatgccaggagcccagctctctccaacgcagcttctacaaaataaacactcgggttccactcaacacattggtgatgcagcgattgggacctgaggctggcctcctcctcctctgctcctcaggccagccctgtggcctaaagtgagggaggtagcatccaccccagcccagtgactttcccaagcccatcctgaaatgcccatgggacctactgatgacctcgtactgcccacagcagggccaagccctgcatggtccgagccacccgcccatgggtactgtcccttctgaggtgaggaagcccgggctaacaccccagcacaaggaaaaggctggaatgggctgctgagaggagagctggaccgaaagtgcctccaaactgtgcttcccccagaaggtacagcctcagtcccctccctctcctcatcacttccgggtttggagccagcaaggaatgaggccaggaagaccttggagacctgcagctgatttcccctgctagtgctggcaccaaggagggccccaggcctggcacagtctggctgacagttctgagacaggatattggagacaggcaggggaacattgctttaacaagcagaataacggccaggtgcggtctgtaatcccagcactccgggaggctgacatgggtggatcatgaggtcaggagatcaagaccatcctggctaacactgtgaaaccccatctctactaaaaatacaaaaaattagctgggtgtggtggcacgcgcctgtagttccgctactccggaggctgaggcagaattgcttgaccctgggaggcggagcttgcagtgagccgagatcgcgccactgcactccagcctgggtgacagagtgagactctgtctcaaaaaaaagaagcagaataacaatttaaggttgtgatagtgactacgaatgctgtgctcacctccaaactccatcccaacactaccctgccccctaagaggggcctgagcatggggtaaaaggctcgctgacagccacagagcaggagcccacgcaagaccaccagaggatgtgcagctgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcaccaccagggatcttgttagacacgcagaggctcagactccatccagccctaaccaccagaaccctgggggctcaaacacacagtcaagtctgagaagggctaggttagaagctttttttccttcttttgtttttacctggacaccactgattggaaagctctctacggcctgaaagccaagcgctccacaagtagtaaacgctcaagggatgggcatcaagtggaaggagaaagcccccaaaacgaagatacatgtcccatgtacacaagctcacaggctggtgaatacaaacggtagacctagaatgtgccacaccaaggctgagcgtgttaccacaggtaccagaatggtgaccacgctggagggttccacaaaccctgatcagagaagtaggcgtgagtggcaggcagagaacacagctctgtgtggcagggagggaggacaagcagtggcagcacagcagacaacaggtggaaattctacatgaaaggcactaaatgggcgaggaaagcctgggccgcccaggtggaagggactatcgtgatcatctctctcaccctagggacaccttaaaaggaggtaactgagccccaaagggaggcacccagcacagctgagtcacagagctgcagccatccaacccacagctccaggagggactctccaacttcacaatttcaaaatcaaccctagcagctaacaatttcttaatgccaagtaaagactagaattagaaacaaacagaaaccctatcatcttctaccatcattacttcacaaaagaaaacatttcaatgatcaaagagcaggaagaactactggcagtcctgcacctatgcagttctccaggcctggcaaaggctctgaggcaaccagcatgaaggagccactgcaccgtctgtacgcaacaccgcctgacccccgggctgggacaagactgagatgacatgctgaaagggaatcagaaaaaacaaaaacacaaaaattcaacaacagatactaaagacgggattttgactagccaaacaaagactaaaagagtatctcccagggatgaaaggaaaatggggatgtttttaaacaagaccaggactgttccagaaacaataagaacgtcaaagcccatcaggaaaaaggtaacaccaaatgttggccaggcagtaaggcaaccagaagtctcacatactttataattttttatttttttgagagagagtcttgctctgtcacccaagctggagtgcagtggcgagatggctcactgcaaccttcgcctcccaggttcaagcaattctcctgcctcagcctcccgagtagctgggattacagaagtgcagtgcgccaccacccgcagataatttttgtatttttcgtagagatggggtttcaccatgttggccaggctggtctccaactcctggcctcaagtgatctgcccatctcagcctcccaaagtactgagattacaggcataagccaccgcacctggccagaaaactcacatggtttagaaaacccttggatggcacaatctaaaactgtgggcccaaggccgtgggtggtggctcacgcctgtgatctcagcactttgtgaggccaaggtgggtggatcgcctgaggtcaggagtttgagaccagcctggcaaacatggtgaaaccccgtctctactaaaaatacaaaaattagttgggcgtggtggcaggctcctgtaatcccagctatttgggaggctgacgcaggagaatcacttgaacccaggaggcagagcttgcagtgagctgagactgcgccactgcactccagcctgggcgacaagagccaacttcgtctctaaataaataaagcaaacaagctagctagctagctagctgtgggcccaaaaactcacccaaggtatacgccaacaagaatgcacacgtatgcacaccaaacaggcaggcacactcatgaaggcccaacaatggaaaacaactatgcccaccctgagaagggacagctgcaggtataaaagactatgagccagcagtgaacaggacagaacgtttaggttgaactgtatgaatttaccttttaggggtaaaaaaacagctggctgctgataatttcacatggtttgacttacaaacaacgcagatgaatctctcaaatatacttttgagcaaagatgccagagccaaaaagactattacagttccatttgcatacattcaaaagcaggcagcactaatcttatgggtgggggttgagagtgactacaagcttcaggatacgtgaggggcttccagggttgtgtttcgcactctggatgctagttacaagggcataatcatttgtgaagaactcttggagctgtgcacacttcttacgtaggctgtccttgaattcaatacgtgcacagaaaccttcagaagggaagcagagatcaacttcatcctgatcagcaagtagactcagtccaggcagcaacctctcctggacccccaaccaataacaacaacacaggaagcaaaatattggcaggacagctggcaacgcggcaatgtccaggatggagtgcccatcctagaggagggagctcacacaagccagccaggagcccacaggaaacagagagactactgtaaatccttattaagagcagactcatgtctgctatctaaaagataaaaacctgataatgtttttaagttgtcctaaggtccaattgactttttttttttttttttttgagacagagttttcctcttgttgcccaggctagagtgccatggtgcaatctcggctcaccgcaacctccgcctcccgggttcaagcgactgtcctgcctcagcctcccgagtagctgggattccaagtgtgcaccaccatacctggctaattttgtatttttagtagagacggggtttctccatgttggtcaggctggcctggaactcccgacctcaggtgatccgcccgcctcggcctcccaaaagtgctgggattataggcgtgagccaccacacccagccccagttgacacttctaaaggagaaggggttctgcaaatcctgaaaggcaagcccaggagaaacaggaaatctgggagcacggcaagcaaggttcaaacaggacaccaaataattcccagcaaccgcctccagcaggtcctggtggcagccaggtagggcaggagccagctgggcatatcaaagggaggaagccaagaagaaaatgggcgagactctcagggatttggggtcaaaggaagccgctgggagaaggaaacagcccacttgctccttcataggtaatcaacacacaaaccccccagtgcctcaaatggctcaggagctacagccaaagatcaaggatcaagttattttactccaagaaagaaaaaaaaaagaaaaagttatacattcggcatccattggaagttttgtgattgtttggagacagggtcttgctctgtggcccaggctggagtgcagtggcgcgatcatagctctaatttatgggctcaagggatcctcccgtctcagccttttgagtagctggaactaaaggtgcatgccacgatgcccaaccaatttttaaaattttttgtagagatgaggtctcactatgttttccagactggcctcaaactcctgggctcaagtgatcctcctgcctcagccttccaaaatgttgggattacaggtgtgagccactgtgccaggccttaaaaagcaatttttacagataaaattgggcaactgctatggaaaatattacaatctatggtcctgtgcctgaaaagcctccaagtgtgatactttatagagaagaggtctctcctgtccagtaggtaacttgaaagtgtctaagagacaagtgcccaagaactcaaagaatgagagagggatccattcaaactcagggagaaaaatgctcacaaagtttcactgtacttctaaactgagtctcagtggtgcattaaggaactggatttagagacagaaaacaaaataaactggcacttctctgcctcaagaagcatagcttgggggtgaaaagtcagctacttagaaagcagcaaaaacaaaacccagaaacccacccaaatgctcactgccagcaggacaggtgattatgtgtggatggcgccaccttggacactgaaatggagaatgggaacgcaggaactgctgctcctggtgtcccaagagtgcaggacacccggctcccagcgaactgagccaaaatcattcgcagtttcaggatccagacaaaggtgggaaaccgacaaaagccagcgaatggctgacccgcaattcagaagactgttggcttctagagggaagtgggaataagccagggagaagtgcatggggtgtcccaggaacttgggaggctatttcttatgtggccatgagggaacaacggtgtcacgcttagtgggacacccacgattcaaccaatagtgggtttaccactacttatctattctttaagatttgtgcacacacatatatacgtgtaatttacctttgtttttttttttttttgagtattcctctgtcgcccaggctggagtgcagtggcacaatctcggctcactgcgacctctgctgcccgggttcaagcgattgtcctgcctcagcctcccgagtagctggggattacaggcacccatcaccacacccagctgatttttgtggtagagacagggtttcaccatcttggccaggctggtctcaaactcctgacctcaagtgatccgcctgcctcggcctcccaaagtgctgggattacaggggtgagccaccacgcccggcctatttacacctttgtaaataacttcttagagttcaatggctaagtatactaaggaagctgagcctgctctgtgcagaagtctcaaaagaaaggaaagtcgggtgtggtggttcatgcctttaatctgagcactttgggagattgaggcaggaggatcgcttgagcccaggagttcaagaccagcctgggcaacaaggcaagaccctgtctcatttataaaacaaacaaacaaacaaacaaacaaaaaacagagagagagagagaaaagaaagagaaaaaagaaagaggaaagagacctccctggaaatcccaatccagggagaagccaagaggctaaagctgaggtgcactcacagagcacctccctttcaccacccgagagatcacctggtccacagccgtcaaactcagcaaggccacacacttgggcagctatgacaacaatgcacaaatgagggctttggagggctcagttcccacaagagataacccagaaaatatcaccctgtcctaatcatacaaagcaaaagaacctggggcctccacacctggggtagcaggtatgcttcactcaacagaagttgtccaggagggagaaatcccaggcaacctcccaaggtctacaggagaaagaagggcagaatcagagccactctaagtgaaaatatcagcgtttagaacacaatcacccccctgcaacccctccagccaaccctcgcctagtccctgtaccctccaattcagagtccaataaccctgagttatctttctcaacacccatctcatcaagccactcccctgcttaaagctttcaatgggccgggcatggtggctcacacctttaatcccagcactttgggaggcccaggcgggcagatcatctgatgtctggagtttgagaccagcctgaccaacatggagaaaccccatctctattaaaaatacaaaattagctgggcatggtggcgcatgcctgtaatcccagctactcaggaggctgaggcaggagaatcacttgaacccgggaggaggaagttgcagtgagccaagatcgcgccattgcactccagcctgggcaacaagagtgaaactctatctcaaaatacaaaaaaaaaaaattaaaaaaataaataaagctttcaataaattcctgatgcctagcataaagtccatgctcaggcctggcatgcaaagcacttcccacaggggcatcaagcccacctcatcccttccacagacacacctgagagctcctgcaggccgtgccctactctgggaggagcctgccccctcacgactccctcctctgtgaagccagaactgcctctgttgtccccccgcttccaacgtcagcaccagctgccaagctgcttccctcctgcctacccccaccaccccatagaccagtacccaaagttagaccctgtgtcccaagcagccacagcagcaggcatgcagcaggcactcataaacattcattaggtgagcaaatgctggtcagacccaatgctgagaagagacagagtgaaacaacatgtgaaagataaggaggcacgtggggaagatggaaatgtccagtaccctccttgccactggttctaaaattgtgttgtttacattctgaaatagtcagggctcctaacgagcatctgcttatgtggcttctctattactgttttgtggggttttttctgagacagggtcctgctctgtcacccaagctgaagtgcggtggtacaatcatagctcactgcaacctcgaactcctggcttcaagccatcctgcagcctcagcctcccaaagtgctgggattacaggtgtgagccactgcatctgggctgttgctgtatttgatgttaccatgtactacaacagtgccctcttattcagtttttttttttttttttcctgagacggagtctcgctctgtggcccaggctggagtgcagtggcgtgatctcggctcactgcaagctccgcctcccgggttcacgccattctcctgcctcggcctcccgagtatctgggactacaagcgcccgccaccgcgcctggctaatttctttttgtatttttagtagagacggggtttcaccgtgttagccaggatggtctcgatctcctgacctcgtgatctgccgcctcagcctcccaaagtgctgagattacaggcgtgagccaccgtgcccggccaaaaaaattttttttaaaggctgagcacagtggctcacgcctgtagtcccagcactttgggaggctgaggtaggtggatcacttgaggtctggagttcgagaccagcctggccaacatggtgaaaccccatctctactaaaaatacaaaaaattagccaagcgtggtggcaggtgcctgtaatcccaactacttgggaggctgaagcaggagaatggctttaccccaggggagggtgtggggtggaggttgcagtgagccaagattgtgccattgcattccagcctgggcaacaagagcgaaactctgtcttaaaaaaaaaaataggctggacgcagtggctcatgcctgtaatcctagcactttgggaggccgacgcgggtggatcacctgaggtcaggagtttgagaccagcctgcccaacagggtgaaatacaaaaattagccaaatgtgttggtgcatgcctgtaatcccagctactggggaggctgaggcaggagaatcacttgaacctgggggaagcagaggttgcagtgagccaagatcacgccattgcactccagcctggacaagagcaaaactccctctcaaaaaaaaaaaacaacaacatttaaaaaaatacaaaaattagctgggcgtggtgacaggtgcctgtaatcccagctactcaggaggctgaggcagcagaatcccttgaacccaggagacggaggttgcagtaaggagagattgtgccactgcactccagcctgggtgataagagtgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctctactaaaaaatatatatatacatacaaaaattagctaggtgtggtggcgcgcacctgtagtcccagctagctagaaggccgaggcaggcaaatcacttgaacccgggaggtgggggttgcagtgagcagagatcgcgccactgcactctagcctggcgacagagcgagactgtctcaaaaaaaaaaaaaagaaaagaaaagaaaaaaagaaggatagcattgctttacacttttataaatctctttaatgtctagcctaatagaagaagctggattctcatatctcctgcattcagtctgttaggatatgcggttttgattaaagtctttaaagaaatttggccttacacagaaagaaggaaggagtattttaataactttttcagaaaactgtctattcttcattgatattacactaaagctcgacaaatgagtttcttaaaagttgctatgggccaggcgcggtggctcacgcctgcaatcccagcacttcgggaggctgaggcaggtggatcacttgaggtcaggagttcaagaccagtctcgctaacgtggtgaaatcccgtctctactaaaaatacaaaaattagccaggtgtggtggcaagcgcctgtaatcccagctactcaggaggctgaagcaggagaattgcgcaactgcactccagactagcaacagagcaagactccgcttcaaggaaaaacataaataaaagttgctatgtaggccaggtacggtggctcacatctgtaatcccagcactttgggaggctgaggtgggcgatcacaaggtcaggagtttgagaccagcctgaccaacatggagatacccagtctctactaaaaatacaaaaattagccgggtgtggtggcacgtgcctataatctcagctacttgggaggctgaggcaatagaattgcttgaacccgggaagcagaggttgcagtgacccaagatcgtgccactgtactccagcctgggcaacagagactccatctcaaaaaaaaaaaaaaagttgctatgtaggctgggcacagtggctcaacacctgtaatcccaacactttaggaggtcgtggtaggaggactgcctgagcctaggagttcaagaccaggaagatcccatctctggaaaaaaaaaaaaaaaacagctgggtgtggtggcacatgactgtggtcctaactactcgggaggcttatgaaggaggatcatttgagcccagaaggtgaggctgcactgagccgtgattacatcatcactgcactccagcctaggcaactgagggagaccacatcgtcaaaaaaaattaaaaataaaaaaaaaattgtaaagcctcatgccgggcatggtggctaatacctgtaatcccagcacttcgggaggccagggcgggtggatcacctgaggtcaggagttcaagaccagcctggccaacatggcgaaacccagactttattaaaactagaaaaaattacaccaggcgcagtggctaatgcctgtaatcccagcacttcgggaggctgaggcgggcggatcacgaggtcagaagttcgagaccagcctgaccaacatggtgaaaccccatctctactaaaaatgcaaaaattagctgggcatggaggcgcatgcctgtaatcccagctactcgggaggctgaggcaggagaatcgcttgaacccaggaggcggaggttgcagtgagcgagatcgcaccactgcactccagcctgggcgacagggaaagactccgtctcaaaaaaaaaaaaaaagaaaaaattaaccaggcgtggtggcaggcgcctgtaatcccagctactcgggaggctggggtaggagaatcgcttgaacccaggaggcggaggttgcagtcagcgagatcgcaccactgcactccagcctgggcgacagggcaagactccgtctcaaaaaaaaaaaaaaaaaagaaaaaaattaaccaggcgtggtggcgggtgcctgtaatcccagctactcgggaggctgaggcacgagaatgacttgaacccaggaggtggaggttgcagtgaactgagattgcgccactgcactccagcctaggcaacagcgagactccatctcaaaaaaaaaagcctcatgcatccttcctatttcatcacacagaaaagtaaaaatatgtgtaattaaaggtctagatttaatactcagtcatctgtactgcctcccctggacatgtgtagaactggtgggtctcagcccccagtgctggctaacagtggggaacacaactctggcagtgcaagtgtccacccagggcagaggccagtgatttttttttttttttttttttttagatggagtctcgctctgtcacccaggctggagtgcagtggcaaaatcttggctcactgcaacctccgcctcccaggttcaagccattctcctgcctcagcctcctgagtagctgggactacaggcgtgcgccaccacacccagctaatttttgtatttttaggagaggcggggtttcaccatgttggccaggctgatctggaactcccaacctcaggtgatccacccgccttggcctcctaaagtgctgggattacaggcgtgggccaccgcatctgaccttgtaacttctaaatatactgaaaaaggtatcggggaccctcagggtctgcaaacaactttgagaatagctgacaagcactgcctcaaatatttctaacaactcgtttacaggcaaggagaatgaggcctggagagcttaagagactggcccacggaggaagcaggagtcatctttccacaaaactacacttccccaaaagctgaactcttggacaaggagcccactgccaaacctaagagtaacaaatttcagcaaataaaaggaagtgccatttccaatggcatcctcgaatactctaagaggcggggctggcagaatccatcaacaggcctccagaggcctgctactaagagccagcaacgctgctgaaagcggcactgcctctgcaggctgtgtgaccaggacccggcgggggccctgcacctggaagcagagggggtcggtgggggaggggtgctaccaggaagcaagatgtgcatgctgcctgctgggggcatgaagtcaaagtcccctcctgcccaaagtggctaggccagccctaggctgccttatcagcatcaacacatgcctggaatgtgggactttggcaacaaccctctcccttcggccagcacggggctgacgcctggtccctgggctctggttcacagtcagaggacaaccaccttgaagcaccagaacccgcacccccagcccatctaccagaagacaatctaccaagagtcaccgagaggagctatcctgcctgtgtccccacaccaccaagggccgtgtctgagcacctcgtttgtccacactcagagaatctcaagagctcagctctggtccctgcaatgtccagaccatcccccacatggctctcctggaggtgttcggcaaaggcacaggctgccgtggggcagaagattcccacataccagacagtaaggagctgcgtgtgactggaaggatgaggacgacccagagaatgctctctggcccctggtccttggggaggaatgggggacctgcaggggaccaccttcccactctgggagccagattccctggctttgtccagagcagccaacccactaccccactcaaaatgaacacctcagctgccctccagcccaagcactgcgcagagtaaggagtcctcactcacaaatgtgtccgaggctttcacacacttcacctggagcttcgccactcacttcttagatgtacgactctgacttctctgagccacttgtacaacgaggactgacaagatgatgaggaccacaccggtgtgttctgacaactgaaccgggcatagaatgcccactgccaggctgagcccaggaacgagcccaggatgagtgcttaccctcttcaccactaccttcctagccttctgtcagaactccgtggggaccatcctcttcccatcttctaagccaagtaccctggtacaagccagacagaaactataatagcagctgcttccataaaggggaagggccatggggtcccggacagggctggggtgaaggggcacaagacctagggcaggaatccacccccagatcactcactcaggacaggaccacctggacccagctaccaagatgtgcaccacccccttccttctgagccccttttcccatctcctctactgcccctggccaggttgctgtcccacctctaagaggcaagatttcctacccaggatgctgaccaaaaccacacccaggggcctacccgtcccctcacatgataggctgctcctagctggcaggagccgtcttatagcctctctccctcaaatacaaacaaaaccccagaacaacctattgttctgttccagcaaagggggccaggcccagccaggccctacctgaagctctctgtctcccgtcccccttcagtcccctcccactcgtccttctctgcccctattagtggcctcatataccttgtccagataacacagcccaagaaaccaacctcagggacaaatctcttctcttccagggagaagaagacagaggtcccaggagtcccaggggcccccattactggccacctccgctcaacccaaactgcactatgtgaggtcccgccagactacatacaggccaacgagagcccaagaatgcagccaggaaaccaggccaggcagactccaaaagcccgtgctacggggtcagtaggacccgcctacagctgagggctataggcagctctccagaggacctcccaggagaagccaacagtgcacatgggctaggttcctcctgctgttcaccctctgtgcccagtaactacccaggaacaggcatgactgactctgccaactcattcactgggtaaccgctgaccccaccaggccctcggagtaaagcagttagtgagaaccgcaggtaaaagcgcgggctactcatccctccgcctgtggattctattatcaacaaagatgcatcacctgctagaagagcggttctcaaacttggctgcacatcaggttcacttcaaaagcttcaggaaaagctagtgccttgggcccaccccagagacaggtatagctcaaggtgagaaccagagcaccagcaggcaggcctctgccaggcagcatgggcaacgtgtgctgggtgaatgtgcggcctgcactcatcacccagaagagccccactgtgtccacacaaggacaggccaccgaagtcccagtccccactctcccttctcacttactttgtgaatgagagctcaccaacagtttaccgtcttccgagtgctgcggcctcaccgcccgacccgcagcaggggtgagggcttgcaaaggccatgcaacagatcctccccctcaaaggggctcaggcctcagtgtggtaatgggagcggccccttcccacacttgtcagagaacccacccacccggtggaatgaagccgaagcccaagccgcagggcaacagcccgggacggcaggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagagcacctagctgacccatccctgttccctctcaccattagaaggacccccaagtccccctgttctaacaccgaggctgcactcccactctccacccactaacattaccataaaaaataaattgaatagttagaaggaggggctccccaaagcctggccaccttcccgagggtcccaagcagtttcttggagtccctctccccactcagtcccgccacacccctctcaggcagtctggcccttccctcctgaactttggcgggctggaaccagctcccagcctctcctcccttatcaagctcactgggggcccacacagagctcccatccccaccagcttttctcgctttgccactcccagctaaaactgggctcaaggcaagcaagcctgcagtccctcagtccctcggggcccagcccctcctcagagccctcccccagcccaggtccctaacccttagggcaaggcccctcccagcaggaagcgaaccctggcggtgccaggcagagtcaaactggaagggctggttcagaagcccctaaatgggagccaggacctctcttagggagggggctttcagccccatcctccctagtgcgatctcagatctctccagacaccacactatatgggcctccacaggcggtggagtcaaaggcatttaccctccagcccccagcaagctacttaacttccaaaagcagctccttccctcctccagaggagaacgggccgcgtgctgaactgcaagcgcctctatcaccccgcccaggcaagtctgtgagcaccagaaagcaggggccaacatgacttggtctaaaccaagggggccaggcactgactttgcgctcagaaaatgtggcggaatgaataaaaagcttgaaaaagagccgcatacatgcctggctggcagtggggtctcccaagcgggcttcacagctcacacagtacccgtgggtccgcgtcctcagtgctctccagctgtctccactgccaccctctaccctaccactgccttttaaaacccagtagcagtcacttcctggttaaaacccctcccctccaggccaaccccaacccacatggcatccagggttctcagccagcccacggccggctcctcccacgccaccgctatgccctctgcgctccgctagatgccagcccttatcaccccatcttataatcatttgttgagtgtctgccttccctaggctgagctccagaaaacagcgatacatgaatgtaaactccagttctgttcccattgtagaaacgaggcaggagagtcaatcactgctcaaggtcatgacgggagtaaatggcagagccagcaatgcactacagactttgcgaccgaccaagtccagttcccctctcactgccccacaggggtccgtcctaggccaggctcggaggagacaagaagggaggaacccaatgtgttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatccgcgactgcagcttgtggagaaggctgggctgctggccaagaccaaggatcgaggatgggatcgtgcctacctgtccccagagcaggtatcatgcagcacaacaggactcatcacccctgccccacctgcgccttctcttctccttccagcaacttcgacaatcatttcggttttgctttaattaaaggcctgactccctcgggctgcttcttcctctacacagaggcagcaaccagagggagatttttcttttcaggaatcggtcgtaaaaactcagtgactaatctacaagttccaacaactggcagaaaaacaccgcagggagaggttgctgggcacacagcagcactcagagccaactgaccagagaagctgggccacaggcactctactacaacctccctcccccagcccgacactggcctgccgacccacctgagagctctgacctcccaaggcaggcagctggggagcctcttcccagccttccaagtctactgctcgtcctgtgggacccagagatcttcacagtctcaatggcacaagacggaacgttcacttccaggcaacaatcctgggccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcagcactgggctcccttacacaggcagtcccaggcagttctgggtggggccgttgggagcattatctggcctcattccctcctctcagcaagtcactgccccccagggagaggcattcccccccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcggccgcgggcgcagggccgtttgcataatgggagccctcccgcctgtcaggcagcgcagctcgcccgacgctgttcggattagattgctaatgaaaaggcacaaagagccggcgcccgctcgcccgccgacccccgctccgcagacccgcgccgcctgggcctggcgcggcccggtgggctttgtgccccgggtgccccaccgcccgcgcccctccgggcatctggcccacaaagcccgggcctgccaggggtcccgcgtgcgccccagcccaggcccgccagacgctagcgcgtcccccacgcgcgcagtcccacgtcgcccgggcgcgcgcgcgtccacgcccctctccccggggacgcgcccagcccgcggccccggcccccgcccgctccccgcgacccccgccccccaaggccgcccctcacctcgtgtgcgtcggcggcggcgctccgcccgccggccggccggccctaccagcggcccttgtcctcagcgcccggctcgcgccgcacgcgcccgccccgtccgcctgccgccagcccggctcggctccccgcctagcgcgccccgagcgccgctcacagccgcccgcccagcgccatcttggaagcttgtgacgtcggcgccgcccgctcacccctgacccacatctgaatgggcgagcggcggggcggggacagggggcagctgggggcgtggcctgtgaacaggggcggggcctcgggggcggggccgggccggacagcggtcccagcactaggcgggcgggctgccggggtccggcgccgtggggaaggggtgcgcgggaggagacggggacccagaccccggacatctaaccggactccgacctcaagcgccagggcaggaccgcgacctcgcccctgaaatacccgaaccgcataccggcccccgggacagggaccctggccccccccgacaggctgacgcccaccccctcaaactctggtggacttacccccttttagccctaccctgacccctaggagccccgaattagggacctctatcggcctacgcgccccctccccgacccctttgcgacccctgctcgacgctccctgcggttgcccgaggctcaaaggcgcagccagcagtgactgcaagctcgggggtctgggctcctggggaagcccgggctggttgggtgcaaaagagaaggggcgcccctcccgtgaccccagcgcccctcgggcccccgcgggcgcacccccgcgaaccctacctgctccgagggcgcggaggacccagcacgctgcgctcagccagccccttccggtggccgcagcccctcgcaggccccaggggtcaagcgcctgcccgagccggcccaccaggacccgggctcccggccgccatgcagatagccttcccaggggctgggctggcctgagccgccactgcttctctagggagctagttaatggacctctctctactttgaacaccaaacaaaggaacacaccgctatcgaggtcgcccaagtccaagaggagcccaggtctgccttacagggaagttgtgccccagctccagtcaagatcaaaaaccagtttcaataacccttcgccaagctgatgatgcaacctttctttcctaatggatgtataggtttaatgtcatcctaacaacatttcttagacttcacaaaattctaagttcacctggaaaaataaatagccgaaaacagctatggttttccccccttgggaacaaaagcaggcatgagggtagacttgccctaacagatatcaaaacaaattgtaaagctaccgcaggcatttcagtgtggtacagaacaggaaatagaatagaaagcctagaaacatcctagaaatggtaagaacacaatagatgaaaaaggaaatatcaaacatctgtggaaaaaaaagagctatcaaacatccctgaagaagaacaagaatattccacaaatagagcctagcagaggactcactatttgaaggaacgactgaaaaaaaaagtcaaccattctactaacccaagacatataaattaaaactataggccgggcgcggtggctcacgcctgtaatcccagcactttgggaggccaaggcgggcggatcacgaggtcaggagatcgagaccatcctggctaacacggtgacaccccgtctgtactaaaaatacaaaaaattagccaggcgaggtggcgggcgcttgtagtcccagctactcgggaggctgaggcaggagaatggcgtgaaccccggggggcggagcctgcagtgagccgagatcgtgccactgcactccaacctgcgcgacagcgagactccgtctcaaaaaaataaataaataaataaaataaaactataagaagctgggttttctcctaaacaaattaaaaatcagtttcaagtgataaccttcaaacacaaggtctgataggtaatcactctcatatacttttggaagcacataaatcacctcaaaattcctggacatgagtttggcggtatgagccaaaagttgtttttttggggttcttttgtctttttttgttttttggagactcggagtctcactctgttgcccaggctggagtgtagcctcaaactcctgggatcaagtgatcctcctgccttccaaagtgctgggattacaggcataagccaacgcacctggccccaaaaatattttaaaataattataccctctcagaccagtattccaggattctgttctggggaaattagccacgtttgcagaccacgtacttattatctgtctctctacccataagtaagtttgtacctgtaagtttggaacccatgcctaggagcacacctgagacaacaggcattccacggtcccttgtttcatctgcatttgaaaactaatgtggctggctcatgcctgtaatcccaacactttgggaggccaaggccggcagatcgcctgaggtcaggactttgagaccaccctggccaacatggtgaaaccccgtctctactaaaaatacaaaaattagccggatatcgcggtgcatgcctgtagtcccaattactcgggaggctgagacaggagaattgcttgaatctgggaggctgaggttgcagtgagctgagatcatgccatgacactccagcctgggcaacagagggagactcggtctcaaaaaacaacaaaaaagataactaatatatgataatattttttaagtgtcatgtataatagtgaaagaaagcatatacaggcggtggctcacgcctgtaatcccagcactttgggaggctgaggcgggaggatcacctgaggtcaggagtttgagaccagcctggccaacatggtaaaaccccgtttctactgaaaatacaaaattagctgggcatggtggcgtatgcctgtaatcccagctacttgggaggctgaggcaggagaattgcttgaactccagaggcggaggttgcagtgagctgagatcctgccattgcactccagcctgggcaacagagcaagactccgtatcaaaaaaaaaaaagaaaaaagcatatacaaatttctcacaatggggttaaatagtccacataatggaatgtagattaggccaggagtagtggctcatgcctgtaatcccaacactttgggaggccgaggcgggcagatcacctgaggtcgggagttcgagaccagcctgaccattatggtgaaaccccgtccctactaaaaatacgaaaagttagctgggcgtgattgcgcatgcctgtaatcccagctactcgggaggctgaggtaggagacttgcttgaacccgggaggcggagattgcggtgagctgagatcgcaccattgcactccagcctgggcaacaaaagtgaaactccgtctcaaaaaaaaaattagccaagcatggtgtcacatgcctgtagtcccagccactcagcaggctgaggcgcagcacgagagttgcttgaacctgggaggcagaggttgcagtgagccgaggtggtgccactgcactccagcctgggcgacagagtgggactccattttaaaaaaataaataggccaggcgcggtggctcacgcctgtaatcccagcactttgggaggcccaggcaggtggatcacgaggtgaggagttcaacaccagcctggccaagatggtgaaaccccgtctctactaaaaatacaaaaattagccaggcatggtgacgggcacctgtaatcccagctattcgggaggctgaggcagagaatcgcttgaactcaggaggcggaggttgcagtgagcccagatcacaccactgcactccagtctgggcgacagagtgagactcggtctcagaaaataaataaattaataaataaataaattaaattagtaggatgggcacggtggctcactcctgtaatcccagcactttgggaggccgaggcgggtagatcacccaaggtcagaagtttgagaccagcctggccaacatggtaaaagcccgtctctactaaaaatacaagattagccaggcatggtgacgtatgcctgtaatcccagctacttgggaggctgaggcaggagaattgcttgagctccagaggcggaggttgcagtgagctgagatcctgccattgcactccagcctgggtgacaagagtgaaactccgtctccaataataataataataataataataaagtaaatttttaattaaaaaataaaatttttatttatttatttattgagacagagtctcactctgtcatccaggctggagtgcagtggcatcatctcagcttgctgcaacctctgcctcccaggttcaagcaattctctgcctcagcctcctgagtagctgggattacaggcgcccaccaccacacccagctaatttttgtatttctagtacagacggggtttcaccatcttggcaaggctggtctggacctcttgacctcatgatctacccgcgttggcctcccaaagtgctgggattacaggcgtgagccactgcgcccagccaaaaataatttaaaaaaaaaaaaaaaagaagaggccaggtgcagtggctcacgcctgtaatcccagcactttggaagactgaggcaggaggatcacttgaggtcaggagttcgataccagcctggccaacatggtgaaaccccatctctactaaaaatacacacaaaaatattagccaggcatggtggcacacccctgtagtcccagctactcgggggactgaggcaggaggatcacttgaacccaggaggtggacgtttcagtgaaccaaaatcacaccactgcacactccagcctggtcaacagagctagaccctgtcttaaaaaaaattgtattttttgtacaaaaaaattagccgggcctggtggcagatgcctgtagtcccagctactcaggaggctgaggcaggagaatggcgtgaaaacctgggaggcggagcttgcagtgagccaagattacgccactgcactccagcctgggcgacagagcgagattccgcctcaaaaaaaaatttttttttaattgcattttttaaatgcatgcaaaaatattgatatatggaaaagcaactgaagaaaataaatcaaaaatatttacggaggttctctctggaagttgggaattttttttctacacatgtatactttagcgtgtgtgttatttttattttatgaaagtaacatttctaatcggaacaattctagagatgctgaagcacattttatttttattttattatttatttttgagacagagtctagctctgttgcccaggctggagcacagtggcgtgattatggcccactgcagcctccacttcctaggctcaagtgattctcccagctgggactacaggcatgcaccaccacacccggctaattttttattttctgtagagacagggtctcactatgcttcccaggctgaactcaaactcccagactcaagcaattctcccacctcagcctcccaaagtgctgggattacaagcatgagacaccatgcccggtaattttttttttttttttgtgcagatggagtctcgcgctgtcacccaggctggagtgcagaggcgcgatctccgttcattgcaacctccgactcccgggttcaagcgattctcctgcctcggcctcccaagtagctgggattacaagtgagcaccgccacaccaagctaatttttgtagttttagtagagatggggtttcaccatgttgccagggttgtctcgatctattgacctcgtgatctgcccacctcggcctcccaaagtgctgggattaccggcgtgggccaccgtgcccagcccatgcccagcaattttttaaagttaaattctccctcctcctccaccctaatcagtcctttctgaagtaacattaacagtttaactctcttctctgacatcaatatgtatctactcaccttacaaaaaagatcctactattttgaaatcatagacatttttctagttcatttccataattcattcttttttttttttttcatgtcagacgggtaatgtgcctatgtcgtaacaagatttgaaggtggcggccgggcgcggtggctcacgcctgtaatcgcagcactttgggaggccaaggcgggcggatcacgagttcaggagattgagaccatcctggctaacacagcgaaaccccatctctactgaaaatacaaaaaaattagccgggcgtggtggcgggtgcctgtagtcccagctactcaggaggctgaggcaggagaatggcatgaacccgggaggcggagcttgcagtgagccaagatcgcgccactgcactccagcctgggtgacggagcaagactccctcttaaaaaaaaaaaaaaaaatatttgaaggtggcacatcttacatgggaacgtgtgtgaacacataatcatcatgcttatgaactacaaaaggatcataattcattctttaagagctgacaaatgttccagagtatggagcttctgtaatttattcacacttcgttaaccatggttgttcagtttatttacagtgtggtgctttttgttttcttttttctttgttctttttttttttttttttttttgagatggagtcttgctcctgtcacccaggctagagcgcaatggcacaatctttgctcactgcaacctccacctcccgggttcaagcaattctcctgcctcggcctcctaagtagctgggattacaggtatctgccaccatgcctggctaatttttgtatttttcgtagagacggggtttcaccatgttggccaggctggtcttgaactcctgacctcaagtgatccacccgcctcagcctccctaaatgctgggattacaggtgtgagccaccgcacccagcctacactgtggtgctattaaaaaatatttttaggctgggcacagtggctcacacctctaatcccagcactttgggaggccgaggcaggtggatcacttgaggccaggagtttgagaccagcctggtgatcatgaagaaaccctgtctctactaaaatattagccaggcatggtgtcacatacggataatcccagctactcgggagtctgaggtgggagaatcacttgaactagggaggcagacgttgcagtgagttgagatcatgccactgcaccccaggctggacaacagagcgagacctcgtcttaaagtaattaattaattaattaattaattaattaatataaataaaatagcagatttcaaaaatttgttctccctggcagcaacccagtaaagctagatctgggcggaaggtaatatggaaatataaaaactacagattagcagggatgggaagacccgccagaaatgggttcattttgtgtcctcactccctccggattctctgtgtgtctagtccaagatctaaccactatgatctgctttcctcatccatttgggaatcagggcaccacccccttgggaggcttgaatgacatgaggttgagcaggcagagcacggaactcaggctctggtgagccctggtacagtgactatgattgttgtgtcatgtaggaagggtctgttattttaccattatctgttttcaataaaaaacagaaagaaaacaaatatacaaaatacccccaaacagtaaatttcagcttcttactatgacagctagatttagcatttaacagtatgcccaaatttgaatttcggataaacaaccaataatgcttaatataagtatgtcccggccgggcgcggtggctcacgcctgtaatcccagccctttgggaggccgaggcgggcggatcacgaggtcaggagatcaagaccatcctggctaacacggtgaaaccccgtctctactaaaaatacaaaaaattagccgggcgcggtggcgggcgcctgtagtcccagctactcgggaggctgaggcaggagaatggcgtgaaccccaggaggcggagcctgcagtgagctgagatcgtgccactgcactccagcctgggtgacagcgagactccgtctcaaaaaaaaaaaaaaaagtatgtcccatacaatatcacttctcaccttcccatatcccaagctcaagacaccttatatacgccatgatttctcctgccatctctgggcattcacaccagggctcctcctgtccaggccagccttctcccttctcccacctgtgcctggtgaacaactcagttcagacatcatctcttgtaggaagtctcctgtgatcccaggctaatcaccctgatacagtcctgaaatactgctgagcagttggcatgagggcaggaaggcttggtcttgttcactcttgtatccagcttatacatggcacaaagtaggttctcaattaaaagtcaaatgaggggccaggtgcagtggctcacgcctgtaatcccagcactttaggaggccaaggcgggtagatcacctgaggttgggagttcgagaccagcctggccagcatggtgaaaccccatctctactaaaagtacaaaaattagccagacgtggtggcaggcacctgtaattccagctactcgggaagctgaggcaggagaatcacttgaacccgggagggagaggttgcagtgagccaagattgcgccattgcactccagcctgggcaacagagcaagactccatctcaaaaaaaaaaaaaaagtcaaatgaagtcgggcacagtggttcgcgcctgtaatcccagcactttgggagactgaggcaggaggatcacctgaggtcaggagttcgagaccagcctggccagcatatgaaatcctgtctccactaaaaatacaaaaaaaaaaaaaaaaaaaatagctgggtgtggtaatgcacgcctgtaatcccagctatttgggaagccgaggcaggagaattgcttgaacccgggacacagaggtaacagtgaggtgagatcatgcaactgcactccagcctgggctacagagcaagactctgtctcaaaaaaaaaaaaaaaaagtcaaatgagaccactcatggtagctggcgcctataatcccagcactctgggaagccaaggcgggaggattgcttgagtccaggagtttgataccagcctgggcaaaacagtgacatctcatctctacaaaaaatttttaaaattagccgggcatggtggcactcgtctatagtactagctacttgggaggctgaggtgggaggattgcttgagcccaagaattcgaggttgcagtgagctatacttgcgccattgtactatagctgggcaacagccagacgcggcctcaaaaaaaaaaaaattttagccgggcttggtggcatgtacctatagtcccagctactcagaagctaagacaggaggatcatttgagcccaggaatttgacgctgcagtaagccaaggtcacaccactgcactcccgcctgggagactgagtgagaccctgagtctaaaacaaataataataaaaacgaaaatgaaagtcaaatgaatgaggccaggggtggtggctcatgcctgtaatcctagcactttggaaggctgaggtgggtgggtcagctgagccctggagttacagaccagcctgggcaacatggcgaaaccctgtctctacaaatacaaaaaagaaaaaagccaggcccatggtggtgagtgcttgaagtcccagctactcaggagggtgaggtgggagaatagcttgagctcaggaggtcaaggctgcagtgagctgagattgcatcactgcagcctagccatgatgacagggcaagacccagtagaaaaccaaggttagagaggttaagtcacctgcccaaggtccgtagctaacctcagactccagcccctcagactgacatgagctcagttcaccctcttaggaacaccatctgaagaatgcatccccagcaagcctattccctatagcaaaggccaggcctgtgatgggtgccccgctcctcaccacacacctccctgtcaagtcaccactccttcacccctagcagagccaggcaccttgagcccaagggaggccactcatggaactgtcattcaaccaacagatgctgacagcaatgatgaggtgggcactgggctagtgaacagcacagatgtgttccctggcctcagaagcccacagactaaggagaagacgacagaatactcacaagggtgctggggctgggcaaaaaggtgcaggctgctttgtctggtcataagaggggaactgacttccctggtctgaggagccaaggaaggggccgtgcccttgccatgccctctgcctgccatgccttgctgttcttcagtgcctgctctaaggtcactcctagtgtggttttctctggctgctctttttttttttttttttttttgagacagagtctcgctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccagatcaactccccttggcctcccaaagtgctgggattacaggcgtgagccaccgcgcccggccactttttttttggagtctcgctctgtcccccaggctggagtgcagtggcgcgatttcggctgactgccagctccgcctcccgggttcacgccattctcccacctcagcctcccgagtagctgggactacaggcgcccgccaccacgcctggctaattttttgtatttttagtagagacggggtttcaccctgttagccaggatggtcttgatctcctgaccttgtgatccgcccgcctcggccttccaaagtgctgggattacaggcttgagccaccacgcctggcctctttttcttttttgttgagacagattctcactctgtcgcccccaggctggagtgcaatggcgcaatcttggctcattgcaaccttggcctcctgggttcaagcaattctctgcctcaagcctcccgagtagctgagattacaggcgcccaccaccacacccggctcatttttgtgtttttagtagagacagggtttcaccatcttggccagactggtcttaaactcctgacttcgtgatctaccagcctcggcctcccaaagcgctgggattacaggcttgagccaccgcacctggccatgctctttcttttttatttgtatttttatctgtttcttagagacagggtctcactctgtcatccaggctggagtgcagtagtgtaatcataacccactgcagcctcaaactcatgggctcaagggatcctcctgcctcagtctcccaagcagctgggactacaggtgtgcaccactatgcccagctattttttttttttttgagacagagtctcgctctgtcgcccaggctggagtgcagtggtgccatctcggctcactgcaacctctgcctcctgggttcaagtgattctctgcctcaacctcctcagtagctggattacaggtacctaccaccatgccaagctaatttttgtatttttttttttttttgagatggagtcttgctctgtcacccaggctggagtgcagtggcgcaatctcggctcactgcaagctccacctctcaggttcacgccattctcctgcctcagcctcccgagtagctgggactacaggtgtccgccaccatgcccggctaatattttgtatttttagtagagacggggtttcaccgtgttagccaggatggtctcaatctcctgacctcgtgatccgctggcctcggcctcccaaagtgctgagattacaggcgtgagccaccgtgctcggcctaatttttgtattttcagtagagacacggtttcaccatcttggccaggccggtcctgaactcttgacctcatgatccaccggcctcggcctcccaaagtgttggggttatagacgtgagccaccgtgtctggcctggctccactttcttagggagctttgcttgccctctgcttggggtagtttgtgaattcagtgctctctctctcccaggtcctgggtctcctgctcctgatcaatctgccacgtgccatttgatctcagagttgtctccaccattagactggcagggtctgtcttctggggtctgtgtgtaggatacagtggccccaggatgggtaaaggaggggacccagttgttcttctgtgataggtggagacaagggccagcagggctgtttctcggtgaaacccatggggagatagtcgaaccaggaaccaaatccggccgggcgcggtggctcacgcctgtaatcccagcactttaggaggccgaggtgggcggatcacctgagttcgggagttggagaccagcctgaccaatatggtgaaaccccatctctactaaaaaaaaatatatacatatatatacaaaattagcctggcgtggtggcacatgcctgtaatcccagctactcgggaggctgaggcaagagaatcacttgaaactgggaggcagaggttgcggtgagccaagatcgcaccattacactccagcctgggtgacagagactcagtctccaaaaaaaaaagtccaaaaattaaaaaaaaaaaaaatgccgaactcagtggctcacgcctatgatcctaccactttcagaggccgaggcgggcacggtggcgcgtacctgtaatcccagctactccggaggctgaggcagaagaatcacttgaacccgggaggcagaggttgcagtgcgctgagatcgtgccactacactccagtgtggtgacagagcgagacttggtctcaaaaaaaaaaaaaagtcctggctgtgccactaggccagacgccctagaactgacttctatggacctcagttttcatacctgtgaaatggaactcagagccatatctacttcattgggttgtgtgaatgtgaggtagttacaggatggagcaggcagaaggtcagcacagcctcagtggttggaggagtgggggtcaagtggacagagagggtaccccagggccagaggtagaggcaaggtgaagcaatgcttcatttccctgctgaggttcctctctagcagtttggaggtggggcaggagtggagaaaacacatcccctcctcaatatgggctgaggaacagggttcttgaggcaccaagaacctctttggggctctggcttgcctcctgtagtgaaagggatgggctgtgtgcaatgaactcacacctgtaatcccaacactttgggagacagagtcaggaggtccagaacagcctaggcaacatagcaagaccttgtttctacaaaaaactttttaaaaaattagccaggcgtggtggtggcacctgtagtcccagctacttgggaggctgaggtgggaggattgcttgagcctggagaggttgaggctgaagtgagctatgatagcaccactgtactccaacctgggcaacagagtgaaaccctgtgtctaaaataaaaagagggcctggcgtggtggctcacgcctgtaatcccagcactttaggaggccgaggcaggcagatcactcgaggtcaggagttcgagaccagcctggccaacatggtgaaactctgtctctacagaagtacaaaaattagtcgggcgtggtggcaggcgcctgtaatcccagctgcttgggaggctgacctgggagaatctctcgaacctgggaggcagaggttgcagtgagctgagatcacaccattgcactgcagcctgggcaacaagagcgaaactccgtctcaaaaaaaaaaacaaacaaataataaaataataataataataataataataataataataataataaagagggtgggagtggaccaaggcctaatggcatggaatttgcaaactttatcttcctagttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatcttgcctgaccttgtggagactgaccactccctccttctggaaaacgttgccccctgccctctccaaggcctcctccttcttacatcccctggtcctggctagggcctcagcacccaattctactccttgacccaccaccctgtggtgcttttgccgggccccagcccacagccatctgccaaacacctccccctggagtccctgcggcgtctctgactcagcaggtctgtgcctgcccctgctgttccccccacccagtggctctgcagagcaccctgttgcccaagccctgagtactggccactcccagggcctcgccttcccccaccaccagcaccaccaatttgaattcctatctctccctctggcctcctccctagacccaggccctgccccagggtgggggaaggaatcctacagataagggcattggtcaaagggacacacctgggttcgggcccccagctctgcccccaacctgctaaatgaccacacccctctccaaatctgagttattccctatgtaaaagggggaaataattaaactagctgggtatgctgtgctgagcaatatgtgagctcaggaaaggtcagttttccaggggaagtatggccgctgagagcctcagtctagtgcttctcattcacgagctggttggtgcctttcctaagttggaaatgggttagtccacaaatcccgttgcctggtccatgccaggtccaggtacctgcattcagggtgcagggtggagtaagacagtctgaagggtgaggtagcaggatgaatgagtaattcctgggtgcgttttgggattatgcctaagggctgtccgagcacgtgggaggggtagctaaatcctgtaagggaggggagaatggggaaggctgcctgcaagaggtggtggagggtgctttcaaaggatacctgggagtgagctggctgtaggcacagggcagctggaaggccaattttagggaagaggaaattgaggctgaaagtcaaaaaacaaaggaactgcctgaggtctctcaactgagaagtgagtgggccagggttcacattcagcccccactccattctcaggctgggcaggaaggtactttgccctcaggagggcaccttcgacccaaagcaccctgaccaagaggctgtgcaccgtggcaaccctaagactgaggcccaggtcctggagttccaccaaggtaggtacaaccagccaggccgtcagtgacaggaggatttactggggcttctagggaccccgtgaaagggcaaaaagacggcacagaagcctgtggatatcagatatagatagtgagggctagggctttatggggagggtggatgggccctgtgggcgggggatgtttaggagatcttccaaacagagcattccagcctgggggaacaacccattatagaccccacccagcaccgaagacagggacaggtggggctgagcctggaggctggcaggacctgtgcggccggctgcggtgtcagcaatgccaccgtgtgtggaaccctctgtgcctaggttcctggagccagctccacctggcaatgtgctttgtttcacaagactagagttggcccatcttgttccgcctcagatggaacacctgacctcctgcacaccccacccagcctccaaattcaaccaccccagtagtgagacagggagagtagggtgtgaccagaaggtggaatgagcttaaaataggctgcagagatatctctgagcttttaaaaagtcgtatctttcatatcgtgttcttgtgaaatcttctccagattttttacaatgactctgaaattgatcagttagcctcatgctttcaaaatccatagccgcagtgagcgagagggggcaggtcagctagaggtggagggggcagatgggccagaggcgcctgggcaggggtggatggggcctggacaggcttagtgacccttgcaccagaactctccggacaccgccccttcgcccactcgttaggctcctctgccttcgggccggctgggctgcccatcccccctcgttcccctcctgggcaggtctggactggacaggttttgggcctccaggtcgtgcagtcagtcagggaaggggcctggtgcaggccacagccaggcatccacctccttcccagcccacccctaccccccagcagcctgccaacttgctagacctgtgcggccttcccttctgctgaaagtctccagattctcagggctctgcacggggagccaagctggggcttagaactgtgctcccttgcccccacccccgacctgtgccctcatcagctttctttttttttcttttttctttttttttttgagacacagtctcgctctgtcgcccaggctggagtgcagtggtgcgatctcagctcactgcaacctctgcttcccgggttcaagcaattctcctgcctcagcctcctgagtagctgggagtataggtgcgtgccaccacaccccgctaattttttgtatttttagtagagacggggtttcaccgtgttggccaggatggtctccatctcctgacttggtgatccacccgcctcggcctcccaaagtgccgggattacaggcgtgagccaccgcgcccggcctattttaaattttttttgtagagacagagtctcaccatgttgcctaggcttgtctcgaactcctggtcgcaagtgatcctcccctctctgcctccgccgtagctgggattgcaggcacaagccatgacgccccccttctcatcagctgtctgggtctttctcggggtcctgacaccaggccaagtgttctgcacacctgacctgctcaaaacaaaaccagttctgccacagtctgggaaaatgaggctcagagaggccttgcagctgtctgtgagcaggctggcatttggatccagtgactgggttctggagcccagtggctctgtggccctgcctctccagccttatgcttctttaaaactgcccatggcctctgaagttgaggatttaggggagcagggctgccagaggggtgaagaaggagatctttctgtgggtgggtgtcagaatgaccaggcctgacactggtccctgctcccctggaaggacagcccctctcggttatgtggggggtgggctgcctagggtgctctggggagaagggagggagagaatggggctggtcgggtggggtgtggattccaggcctgcttggtcaaaaagatacagtatttcctattcccccttacactgggcaggcaggtgtggcccaggcagctctgccaggtgtgcagcccctggagaatgaccctaaagtgcacctaggctgccccctggcggcagcatgaggtcctcctccctggacttgtaaccctcccagggggaggaggtccacaccagctgatgggttggcacctgtccccagtccctttcttctttcctgtgccactgctcccagagttgcccaaaacacacgatcaggtgcagtggcttgaacgaaaccctgtctctacggaaaatacaaaaattagccaggcatgttggctcatgcctacagtcccagctacttgggaggtttaggtgggaggatcgacagcccaggaagtcaaggccgcagtgagcagtgagctgtggttgcgccactgtactccatactgtagcctgggtgacagagtgagaccttgtcttttttttttttttttttttgagacggagtctcactgtgtcatccaggctggagtgcagtggcgcgatcggctcactgcaagctccgcctcccggattcatgctattctcctgcctcagcctcccgagtagctgggactataggcgcccctcagcctcctgagtagctgggactacaggcgcccgctaccacgcctggctaatttttttgtatttttagtagagacggggtttcactgtgttagccaggatggtctcgatctgctgacctcgtgatccacccgcctcggcttcccaaagtgctaggattacaggcgtgagccactgagcctggccgagaccttgtcttaattaaaaaaaaaaaaaaaaagataaaaacctaggtaacatgctggggggtgatgagggttatggaggaaaataaaacaggtgggggctggagtgaagagtgggggtgcccctcataactctgacaaagactacaacgcagctgtcagaaaaaaagctgatttgaggcaatggtcagggaaagttgtgaaattaagtaaaaagtgatggaacaggctaggtgggaagtggtggctcacaccaataatccaagtgctttgaaaggccaagcaggaggatctcttgaggccaggtgtttgagatcagcctgggcaacatagcaagaccctgtctttacaaaaaatgtaaaaattagctggaggctaggctcagtggctcatgcctgtagggaggccaaggtaggtgaattgcttgagcccaggaatttgagaccagcttgggcaacatggcaaaattccatctgtacaaaaaaattgccaggcatggtggctcatgcctgtaatcctaacacttagggaggccaaagtgggcagattacccgaggtcaggagtttgagaccaccctggccaacatggtgaaacctcgtctctactaaaaatacaaaaattagctgggcgtggtggcgcatgcctgtaatcccagctactcgggaggctgaagcaagagaattgcttgagcctgggagacagaggttgcagtgagcctagatcgtgctactgcactccagcctgtgtgacagagcaagactatgtttcaaaaaaaaaagaaaaattagctaggtgtggtgacatgcacctgtagtcccagttactcaggaggctgaggtgagaggatcacttgagcccaggaagttgaggctatgatcgtgctactgcattccagcctgggtgacagccagattctgtctcaaaaatcaaaacacaacagggcacagtggctcactttggccttccaaagtgctgggattacaggtctgcaccaccatgcctggcctgagagtgcatgaattaaagtttctattctcttgctagtctgtcattgcttccctagtgtgtgggaaccatacttgtccccacttctcagtcagagagcagcctgccaacctccaagtctcttgcccctgacccaaaaggtcccaggctgtcctctcggcagaagcagctgtcttgtggcttactgtgctcagactccatttctaggctgtgggctcatcagggatctagtgctttgaaaaagtgtaaaggagagcagcagtattattcacaatagctaaaaggtagaaacgaccaaagtatccattgacagatgaatggataaacaaaatgcattacatacacacaatggactattattcagccttaaaaaggaaggaggccaggtgtggtggctcacacctataatcccagcgctttgggagactgaggcaggcgaatcacttgaagccaggagttggaaaccagcacagacagcatggggaaaccccctctctactgaaaatacaaaagttagccaggtgtggtggcacatgcctataatcccagctactctggaggccaaggcatgagaatcgcttgaacctaggaggtggaggttgcagtgagccaagatcatgccactgcactccagcccgggtgacagagtgagacactgtctcaaacaaacaaacaaaaaaaaagaaacgtgtggtggaagaagggaagaaaattggccaggcacactctggtaggggatggttggatgatgaaatacagacaatagaaaaacctagataaagacctggcgtaatggctcatgcttgtaatcccagcactttgggaggctgaggcggaaggatctcttgaggccaggagtttgagaccatcctggtaaatatagtgagaccccagtctcttaaaaaataataattggctaggcgcgatggctcacgcctataatcccagcactttgggaggccaaggcgggcggatcacctgaggtcgggagttcgataccagtctggccaacatggagaaaccccatctctgctaaaaatacaaaattagctgggcgcggtggtgtgtgcctgtaatcccagctactcgggaggctaaggcaggagaatcgcttgaacctgcaaggtgaggttgcagtaagctgagattgtgccgttgcactccagcccaggcaacaagagtgaaactccatctccaaaaaataaaaataaaaataaaaataaaaaagaaataggccgggtgcagtggctcacgcctataatcctagcactttgggaggccaaggtgggggcggggtggatcacttgaggtcagaagttcgagaccagcctggccaacatggtgaaacccaatctccactaaaaacacaaaaaattagccgagcatggtggtgggcacctgtaatcccagctactcgagaggctgaggcaggagaatggcttgaacctgggaggcggaggttgcagtgagccaagatcaccccactgtactccagcctgggtgacagagtgaaactgtctcaaaaaataaataaataaataaataaaacttttaaaaagtaagaagaagaagaaaaaaaatatatggaaattaaaaaacaagaaaaaaataataggccaggtgcagtggctcatgcctgtaatcccagcactttgagaggccgaggtgggcggatcatgatgtcaggagttcaagaccagcctggccaacatagtgagacctcgtcgctactaaaaatagaaaaaaattagccaggcgtggtggcgggcacctgtaatcccagctacttgggaggctgaggcaggagaatcacttgaacccatgaggcggaggttgcagtgagccgagattacgccattgcactccagcccgggtgacagtgcgagactccatcaaaaaaaaaaataaataaaataaataaatattaataataattttaaacaattaaaaaatatgggatttttttgagacagagtctcactctgtcgcccaggctggagtgcagtggcatgatgtcagctcactgcaacctccgcctcctgggttcaagtgattcttctgcctcagcctcccaagtagctgggactacaggcacgcgccaccacgcccagctaatttttgtatttttagtagagacagggtttcaccatattggccaagctggtctggaactcctaaccttgtgatccacccgcctcggcctcccaaagtgctggaactataggtgtgagccactgcacccggccaaaaaatatgttttttaaaataatagagatgaggccgggtgtggtggctcacacctgtaatctcagcactttgggaggccaaggtgggtggatcacttgaggtcaggagttcgagaccagtctgggcaacatggtgaaaccctgcctctactaaaaatacaaacctgagctgggcatggtgacgcatgcctctagttccagctactcgagaggctgaagcaagagaatcgcttgaacccgggaggcggagactgcagtgagccaagatagcaccactgcactccagcctgggagacagagcaagaccctgtctcaaaaaataaaataaataaaataaaataaaataaaataaaataaaataaaataaaataaaataaaataaaaaataaaataaaataaaataaaataaaataaataaaatagatgaaggccaggtgcagtggctcacgcctgtaatcccaacactttgggaggccaaggcaggcagatcacctgagttcaggagttagagagcatcctggccaacatggtgaaaccctgtctgtactaaaaatacaaaaaaattagccaggcattgtggcgggcggccaataatcctggctacttgggaggctgaggcaggagaatcacttgaacctgggaggcggaggttgcagtgagccaagatggtactactgcactccagcctgggtgacagagcaagactctgtctcaaaataataataataggccgggcacggtggctcacacctgtaatcccagcactttgggaggccgaggcgggcagatcacaaggtcaggagatcgagaccatactggctaacatggtgaaaccctgtctctactaaaaatacaaaaaattagccgggtgtgctggtgggcgcctgtagtcccagctacttgggaggctgaggcaggacaatggcgtgaacccggtaggcggagcttgcagtgagccaagatcgtgccattgcactccagcctgggcgacagagcgaaactccacctcaaaaaataataataaaataaaataaaaataaaaataataataatagagatgaggttttgccatgttacccatgctggtctccaactccttggctcaagtgatccatccaccttggccttccaaagtgctggaactacaggcttgtgccaccaccctggccttaaacaattattcatgaaaggaaggaaattctgacacatgctgcaacatggatgaagctcaaggacattatgctaagggaaggaagccaaagacctgccagccgaggtcccagtccgtcaagggctccagtgagcgagcaggattgagcaggtccctgggctgagcagtgggaactctgctttgctgtgagtgtggcacgggtggcggcagactgtggagtgcaggctctgtggagcaactggacactctgttgaacgaagtgcaaggtggtaggtttttgcttttttttttttttctgagacagagtctcactctgtctcctaggctggagtgcagtggcatgatctcgactcattgcaacctctgcctcccgggttcaagcaattctctgcctcagcctcctgagtagctgggattacaggcgcgagccaccacacccagataatttttaaaatatttttggaagagacggggttttaccatcttggccaggctggtctcgaactcctgacctcgtgatccacctgcttcagcctcccaaagtgctgggattacaggcatgagccaccgcgcccggccacaaggtggtagtctttctcaaggacgctggggcaaccccattgcgtcttcaccaacaccctggtacagatcctgcagctgcagtctaccccgcatacaacatgttcaatgatccctagctagacaaggcattgaaaactattccataggccgggtgcagtggctcctacctgaaatcccagcagttttggagcaaggcgggtagatcatctgaggtcaggagttcgagaccagtctggccaacatagcgaaacaccgtctcttctaaaatacaaaaaattagctgggtatggtggtgcatgcctgtaatcccagctacttgggaggctgagacatgagaatcacttgcaccaggaggcggaggttgcaatgagccgagatcacactactgtactccagcttgggtgacagagtgagactctgtctcaaaaaaaaagaaaaaaaaaattagctgggcatggtggcatgcacctgcaggcccagctactcaggaggctgaggcaggagaatcgcttgaacccaggaggctgcagtgagccaagatcgaaccactgcaccacagcctgagtgacagagtgagactccatctcaaaacaacaacaacaacaaaaatcaactattccttgggaggcagaggcaggaggatggcttcaggccaggagttggagccaagctaggcaacatagcgagaattcctcatctctacacacacacacacacacacacacacacacacacacacattaattagctgggtgtggtggcacatgcctccagatactcaggaggctgagcgggaaggatggtttgagccctggaggttgaggctgcagtgagccatgatcacgccatgacagaatgaggaccaggtggaagaactgaaaacgctggggatccacacatccgctccatcctttcagatggaaagaaataccaagactcaaaaaaatgagggtgcccaggtcctcactgagcagagactcactgctaaaaaaaagccttacctatttgggttttcactagtaagcagttggtttgtaagcagttggtgattttagtttgtctgggtttcagccatgaatattctattgtaaacttaattataacaactgcactgtaataattcaatgtcctattatgatgttgttatagacaaaatttgcctttacattgtcatttattttattttatttttcttttgagacagggtctcactctgtcacccaggctggagtgcagtagctcaatcttggctcactgaaaccactgcttcccaggctcaagcgattctcccacctcaccttctcgagtagttgggaccataggtgtgaaccaccatatcaggccaatttttgtatttttagtagatacggggtttcaacatgttgcccaggctggtcttgaattcctgtgctcaagcgatccacttgcctcgcctcccaaagtgctgagattacaagtatgagccattgacatttaatcttccttccttccttctttccttccttccttccttccttccttttctttttttgagatggagtctcgctctgtcgcccaggctggagtgcagtggcacgatctcggctcactgcaagctccacctcctgggttcaagcatttctcctgcctcagcctccggagtagctgggactataggcgcaggccaccatgcccagtgattttttatttttattttttttgagacggagtctcactctgtcaccagcctggagtgcagtggcgcattcttggctcactgcaacctccacctccagggttcaagcaattctctgtttcagcctcccgagtagctgggattacaggcacccaccaccacacccagctaatttttgtatttttagtagggatggggtttcaccatgttggtcaggctggtcttgaactcctgacctcgtgatccaccaacctcggcctcccaaagttctgggattacaggcgtgagccaccgcacctggcctacttttttaaacttaaattttaaaaaaaattaagtttatttttaatgtgatttatttatttatttattttttagatggagtctttctctgtcgcccaggctggggtgcagtggcactatcttggctcactgcaacctctgcctcccgggttcaagtgattcttctgcttagcctcccaagtagctggggctacaggtgcatgtcaccacgtccagctaatttttttgtatttttagtagagacagtgtttcactgtattggtcaggctggtcttgaactcctgaccttgtgatccgcctgcctcagcctcccaaagtgctgggattacaggtgtgagccatggcacccggcctatttatttatttattttttaattttttttgagacggagtctcgctctgtcacccaggctggagtgcagtggtgcagtctcggctcactgcaagctccacctcccgggttcatgccattctcctgcctcagcctcccgagtagctgggactacaggcgcccgccaccacgcccagctaatttttttgtatttttagtagagatggggtttcaccgtgttagccaggatggtctcgatctcctgacctcgtgatctgcccaccttggcctcccaaagtgctgggattacaggcgtgagccaccgcgcccggcctctttcaatcatttctgatgacaccggagaaggcagtgtcctttccttattgtctctttttttttttttacctgggtattctggaagtgtctttcctctgacagtgttgttggacgtggggaaacaaaagggtatcaaagagagggagagaaggataaagaccacccctcattcccgccctcccagaggggcagcctggggagtctatggaggaggtgactttgagccatgatgtgaccttagatgaggggcctctctgagcctcaggaagctcttctgcaaaatggggcaaataaagaaatgccctctgtgtgcagtggctcaggcctgtaatcccagcacttcgggaggccaaggcaggagaatcacttgagcgcaggagttccagaccagcctgggcaacatagtgggaccccatctctaccaaaaaatttaaaaattagccaggcatcaggtgtggtggctcaggcctgtaatcccagcactttgggaggttgaggcaggcagattgcttgagcccaggagtttgagaccagcctgggcaacacagtgagacccctgcttctacacacacaccaaattagccaggtgtggtggtgcacatctgtagtcccagctacttgggaggctgaggtgagagaatcatttgagccctgaagctcaagactacagtgagctgtgattgtgccactgccctccagcctgggcaacagaccaagactctgtctcaaaaaaaggaaaggtccaggcgcggtggctcatgcttgtaatcccagcactttgggaggctgaggtgggcggatcatgaggtcaggagattgagaccatcctagctaacacagtgaaaccccgtctctagtaaaaatacaaaaaattagccaggcgtggtggcgggcgcctgtagtcccagctactcaggaggctgaggcaggagaatggcgtgaacccgggaggcagagcttgcagtgaactgagattgcaccactgcactccagcctgggcaacagagcaagactccatctcaaaaaaaaaaaaaaaaaaaagtggaaaagaaggccggacgcagtggctcacgcctgtaatcccagcactttgggaggctgaggcgggcagatcacgaggtcaggagtttgagactagtctggccaacatagtgaaacactgtctctactaaaaatacaaaaaattagccaggtgtagtggtgtgcacctgtaatcccagctactcgggaggctaaggcaggataattgtgtgaacccgggagacagaggttgtggtgagccgagattgtgccattgcactccagcctgggtgacagtgcgagactctgtctccaaataaaaaaaaaaaaggaaaagaaattccatcccaaggtgatccctcacaggaagtgactcagaaaagcagtgagctacgaaagctatctgaatgaagcaagatcgtcatgtgggagacactgactacccactcctagcaaagggctcagcagcacacggcctccctgcggggatgccctcggggaagatgtggcccagaggagttttttgggccttgctcctcagtcctggctcttagtaggaccctctgcagccaaactagcatatcctgagccaggctgaccttaaaaagtaagcattcagggcctagggaccttgggcaaagcagagaagctggtgtcagatgaggtgcagcaggtacagtaggataaggtgttctcaggtcgccagtgcagccccaagatgagcctgcagtattttccttacatgatctggtcctactgtgggcagcgctgctgcccagagcctgagaggattatgaaaacatggcaacggaagtgaggccaggggacacagcatgggggcatgaggagcaggggacagcgggtggggctagaggagagggaggtttagggaggcctctgctgctgtgactgtgagccccagccaatgatgacgtggccaccgcacaatctgagttctgggaaccatgtgatggaatgtgttctgggaatagactgcagccaggaaaaaaaaagcagaagggtgcaccctcccttcctcagccaggaaaacatttctgtagcccttgcggacccaatgcgcagaagtgagagggaggaaagccaggctcatgtttccttggttgtgcttcaacttctaaaatatgttttttctatgaacattttaatgaggggttggacataagacagaaaaataacattctgagagctcgtttggaggttctagcaggggagcgcagctactcttatactcttgactgaagaccgatcgtcctctatcggggatggtcatcctcttccattgagcacacagcttctggagggacgcacatggagtggtgagggaggaaggggatacccgcctagtcagccagatcagccgaatcaaccctgatgatcaatggggtgacacatgtcgcagccagatcaccctcacatcccaaaaataacactcagattgctttttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggttcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccacagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctgggagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatagggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacatccagcggtgggtagggaggtcctgccaagagtgtgtcgaaggtgacggtggaggacatagttccccaatacacctgcagcaagtcccgtggcagccgcacctccacccgcgcccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccactccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcctcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgcgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagcttgcgggcgcggtcagctaggcgccgcgcgagcccggtcagctccgcgcgctttaccttgagccgcttcaccttctcgtctgcctggtaggggcagcctgcacgccgcagctgcttgttctccgcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgtcgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgcttctagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctggaaaatgcagcaggataggcctcaacttggctagacctggactccccaggacccttcagccccctaacagccctgatcacccaactggtcatccaccttttgaggaaaggatgtgcctgatacacatttgtgttactgcgcagagtcggctcagaggaggtgtaagcgaaaagaccctccccagcaaggtggcatagggacccagggccagataggcatgaggggcactgcccaaactggccatctggcctgtctacctcccacatccaggtaccacctggtgacaaacactggagccccagtgtctgggctactcattggcatcttaggtagaggcctcaggatgggccaggagtgagggtgaggcttcagcagaaatgttggaggcatcctgagctgcagaagaaacacacacacacacacacacacacacacacacacacacacagctgcagaagaaacatacacacacacacatactgagctgaaggaatacacacatacactgagctgcagaagaaacatacatacacacactgaactgaagaaatacacacacacacacacacacacacacacactgcctctctgactggtggccacctgtgtggcttgggagctaagaagccctgcttcagtctggctcctctttgcccttcctgtctgctcctggtgccaagtggcttttgggagacatggatggacacctgatacctggcagtctgcatcgagacattgatttttttttttttgagatggggccccactctgtcgccaggctggagtgcagtggcgcaatcttggctcattgcaacctctaccttccacgttcaagagattctcctgcctcagcctcccaagtagctgggattacaggcttgagccaccatgcccagctaattttttgtactttttagtagagacagggtttcagtatgttggccaggatggtcttgaacttctgacctcaagtgatccacccgcctcggcctcttaaagtgctgcgattacaggcatgagccactgtgcccgacaagaccttgatattgaagtcacatcagaggcccctttgcttcttggtctgtcgtgtctccctgtccccaggaagcacctgggacctctcacaactgctgtgttcactcagcttatggccctcctttacaacactcaagtttttcaaatcagtttccccggaacccacagaacatgcctttaggcagtgtcaagtaacaagaacatcgggaattatggctccagatgttcttttttttttttttttttttgagatggagtctcgctctgtcgcccaggctggaatgcagtggcgcaatctctgctcactgcaagctccgcctcctgagttcacgccattctcctgcctcagcctctcaagtagctgggactacaggtgcccgccaccatgcctggctaattttttttgtattttcagtagagatggtctcgatctcctgaccttgtgatctgcccgcctcagcctcacaaagtgctgggattacaggcgtgagtcacggcgcatggccctttattttattttattttattttattttattttattttattttatttgtgagacagagttttgctctgtcaccaggctggcatgcagtggcacgatttcggctcactgcaacctccaactccctcgttcaagtgattctcctgcctcagcctcctgagtagctgggattacaggcatgcgccaccacgcccagctaatttttgtatttttaatagagacagggtttcatcatgttggccaggatgatttcgatctcctgaccttgtgatccgcccactttggcctcccaaaatggtgggattacaggcgtgagccaccgtgcccagcccagatgttctttatgagaggtgaggcagatgtagtgtgtatgtgagaggaaggggaggtgagatgcagggatggccttagccttgaactggtgctgggctcctgggcatggtagccacagggaggactatcttgagagaatcttcatcacagccctgttttacggaagagaacctgaggctcagtgagagccactggcttgccagggcacatgggcaactgaggcagagctggtgggtggggtttcacagcctggatgccctgctgcagtctccagtagggcctcaactgtcaggtcaggagggcaggctgggccgggcatggtggcacagacctgtaatcccagccctttgggtgaccagggtgggaggatcacttgagcccaggaactcaagacctgcctgagcatcatagagagaccctgtctctacaaaaaaaattttagctgggcgtgctggtgcatgcctgtagtgccagctacccaggaggctgagatgggagggtcacttaagcccgggagtttgagactagcctgggcaacagagtgagcgagacccagtctgcatttccagctgagatgaaatgattgcttgagcctgcaaggtgaggtcaaagtcgcagtgagctgtgatggcaccactgcactccagcctgggcaacagagcaagactgtctcaaaaaaaaaaaaaaaaaaaaaaagcctggtgcggtggctcactcctgtaatcccagcactttgggaggccaaggcaggcgtatcacgaggtcaggagatagagtccatcctggctaacatggtgaaaccccgtctctactaaaaatacaaaaaattagccattagccaggcgtggtggcgggcacctgtagtctcacttatttgggaggccgaggcaggagaatgacatgaactcaggaggtggagcttgcagtgggccgagatcccgccactgcactccagcctgggcgacagagcgagactccatctcaaaaataaaaattaaaattaaaattaaaaaaagagagtaggctgtcaccaagaaaaaggacactggggtggatgggtctctgggaaccccacagttaccatccagcagctgccccaaagtatgtcaaaagcattcgggaatgttggttgagtggatgagcaaagccaggcttccccagggctgggtttctgccatccctgttctcatcatgttgtgcagtgattgtccagtgacctgcctgtcacccccatcaactctgatcttggggagagcagaagccatgttttcccttgtccctattgcatccgtgcatgtgacttagcacatcactggtgcccaagacatatgagaatgagttgcagggaggcaggagtccctgcatgagctcaccatgctgctgccttctccaggttcaactttctcacctattaaatgaaagagatggtttcttttttttttctttgagatggagtctcactctgtcacccaggctggagtgcagtggcatgatctcggctcactgcaatcttcacctcctgggttcacgtgattctcctgcctcagcctctcaaatagctgggattacaaacacctgccaccatgcctagctgattttcatagttttagtagagacaaggtttcgccatgttggccaggctggtcttgaactcctgacctcaagtgatccacaggcctcagcctcccaaagtgctgggattacaggcatgagccaccatgcccagcctgaaagtggtggtttcaaactgggttctttagggctccagggttccttggaaatatagaactgctgggcacacacctatactcccagctacttgggaggctgaggcaggaggcttgcttggatccaggacttctggattgtaatgtactatactgatggggtgtctgcactaaacttggcataaattggtgacttcctgggagcaggaaaccaccagcttgtctaaggagaggtgaactggcccaggttagaaaaggagcaggttggccgggctcggtggctcatgcctgtaatcccagcactttgggaggccaaggtgggcaggtcacctgaggtcaggagttcgggacccgcctggctaacatggtgaaaacccgtctctactaaaaatgcaaaaattagctaggcattgtggcgcatgcatgcctaatcccagctacgcggcaggctgaggcaggagaattgcttgaatctgggaggtggaggttgcagcaagctgagattgcaccactgcactccagcctgggcgatagagtgagattccatctcaaaaaaaaaaaaaaaaaaaaaagaaagaaagaaaaaggaaaacgaaaaggagcaggtcaaaactcctgtgctggctgggcgcagtggctcacgcctgtaatcccagcactttgggcagttcaagaccagcctgaccaatatagtgaaaccccatctctactaaaaatacaaaaaattagctgggtgtggtggcaggcgcctgtagactcagcttctcgggaggctgaggcaggagaatcgcttgaacccgcgaggcagaggttgcagtgagccaagatcatgccattgcactctagcctgggtgacagtgcaagactccatctcaaaaaaaaaaaaaatttttttttttgtaggctgggcgccgtgactcatgcctgtaatcccagcactttaggaggccaaggtgggtggatcacttgagatcaggagttcaagaccagcctggccaacatggtgaaaccctgtctctactaaaaatacaaaaattagctgggcatggtggcaggtgcctgtaatcccagctactcgggaggccgaggcaggagaattgcttgaacccaggaggtggaggttgcagtgagctgagatcacgccattgtactccagcctgggcaacagagtgagagtctgagtcaaaaaaaaaagaaaaaaaattaacaacaggccagatgtgacggctcatgcctgtaatcccaccactatgggaggctgagacgggcagatcacttgagctcaggagttcaagaccagcctagacaacacggcaaggctgcatctctataaaaaaattacaaaatttagcctggcatggtggtgcacgcctgtagtcccagctatttgggaggctgagatggaaggataccttgagcctgggaggcagaggttacagtggactgagattgtgccactccacttccacctggacgagagagccagtccctgtttcaaacaaccaaaaaaacaaaaaacccacccccccaaaataaaaacaataataataataaaaataaataaaacagaaataccataggccttttgggaggaggtatgcaggaagcggatggggagagacagtgcccctacttgcttcaatgggcagatctactctttttttttgagacggagtctcgctctgtcacccaggctggagtgcagtggtgcaatcttggctcactgcaacctccgcctcacgggtttatgccattctcctgcctcagcctcccgagtagctgggactacaggcgcccgccaccgagcccggctaatttttgtattttttagtagagatggggtttcaccatgccagccaagatggtctcgatctcctgacctcgtgatccaccctcttcggccttccaaagtgctgggattacaggtgtgagccacagcacccggccggcagatctactcttaagtgtcacttatcagattcgaagaagggttttggtttaataaagcgttatgctccttgaaacaagtttcagaacccctgggttagaggacctcttgcccattgtgtgctcacacacacacgacacacacataccccatcccagtacgtaatgacttccctgacccggagagaaggcgatatgtcccccttacatctcagttggctccacatcgccagctctgtattccactttccctctctctacaaccccagtctatgacttttgggccatggagtctgggttcctgggcaacctggttcacatccttctcctgccggcatggcctggctccatttctgttcggctaccaaagccccaagctttgtggagcctgcctggccttgaggaggggaatgggctccatcctgagagcctgcaggagggtttaagcttcccatcccccattgctacagtagctcccccagcttttcattccatatcctttatttttatttattaaaaacttaatttttggccgggcgcggtggctcacgcctgtaatcccagcactttgggaggccgaggcaggcggatcacgaggtcaggagatcgagaccatcctggctaacacggtgaaaccccgtctctactaaaaatacaaaaaatagccaggcgtggtggcgggcgcctgtagtcccagctacttgggaggctgagggaggagaatggcgtgaacccgggaggcagagcttgcagtgagccaagatagcaccactgcactccagcctggcgacaaagtgagactccgtctcaaaaaaaaaaaaaaacaaaaaacacttaatttttttttttgtagagacagggtctccctatgttgcctgggctggtctcaaactcttaatctcgagtgatcctcccacctcagcctcccagagggatgggattacaggcatgagccaccatacccagccacatattttttatttttgtttctatgtgttttctgtctgttctttgctgtctcctccatgtctagaacagtgcctggcacatgataggtgctcagtaaatacaggactgaagaagacagaggcagacaggccagatgtggctgctgtccttagggaattgacagtccatgatctatgagaatgagctgcagactgggaggcaggtgtcccagcatgggctcaccaagctcctaccctctcccggtccagctttctcacctatgaaataaaagtgaagctggacatggtggcccacgcctctaatctcagcagtttgggaggccaaggtgggtggatcacttgagatcaggagattgagaccagcctggctaacatggtgaaaccccatctctactaaaaaacacaaaaattagccgggcgtggtggcagttgcctgtaatcccagctactcgggaggctgaggcaggagaattgctttaacctaggaagtggaggttacagtgagctgaggttgtgccactgcactccagcctgggtgacagagcaagactctgtctcaaaataaataaataaataaacaaacaaacaataaatgaaagtgatggattacatgaatggttttcaaactgggttcctcagggctcagtttgggggagaatgcaaaggttaaatacaaacaacaatggaatgtagtaacattggcgcttgggcgagtgctctgggtgaggaatgtggtgctcatggggagaagagccgcatcagagcaggcttcctgcatgaggcaaggaggaaacacaagagctgagagctgaaggagagggagtgagggctgccagaggagctgggaggcgatttcaggcagtgggaactggagctgcaaacccccagcctcctgcagtctggctatctgtaccagccctcacccatgcccaccaccctcagggcactcacatcccttcttgcactgatattttcccgtcctatcatgaccctcgtttgagggtgcagggaggactggagctcagagagggagggtcacctggccagaccctaacccgctgagttccagtggagttccttccatcccccagcactggatggggctggatacctggagagggaccgtgctgctcttcctgggccctgcagcctgcctggctggtccacatcttcctgggccaggagggcagtatggtgcgagcttctagctctctggctggggccccctggcctactgggctggcttcctgccctggtggccctggcccagctccccagctcatgtgcctctgcagcgagtggtcagccccttcccatctgcactttacaagcctcatcgctgaatcctccccatagccagagagcctggcactctcctctccagagaaggaaactgtccagggtcacacagggacttatgggcaggtctgtgtgacctgagtctgggctctgaactggtgcttgcagggtcttgccctctggctctggcagcctgagtgttactgtaatccctgagcctttgaacaagcaggcactgcttcctgagatccccattgctgctgtcagcgtctctgtttcccagctccacactgctgccaggacagacgtatcttctgtcttgtagcatctccatttctcttccctttagatctatttttttttttttgagatggagtctcgttctatcatccaggctggagtgcagtggcacaatcttggctcactgtaacttctgtctcctggattcaagcgattcttctgcctcagccttccaagtagctgggattacaggtgcatgccaccacgcctggctaatttttgtatttttagcagagacgaggtttcaccacgttggccaggctggtctcaaactcctgacctcaggtgatctgcccacctcagcctcccaaagtgctgagattacaggcatgagccaccgctcccgggctggatctatttcaatcaccctccttcctctgcagcctgaaacttgaggctttgcccacttcccaaaggcacgagtagcaatgaccatttgttctgtcatttggccatagctctaggtcagaggacagtccttcatcaaatgtttgttaagcatgcaatctagacaggggaggacaagggccaagtaatgtgttaatttcttcattcactaagcacagagaatggagtagaaggaaggtggaaaggagaaggaaggaaaagagagaagaaggaggatagaaaggaaggaaggtgggagggagaaaggaaagaaagagggagtcctttaggttatctaagtcccctcaggacttggtctggccctcacagttcaagaacagacttgggcttgagcctctgaccagccagatgactgagaagctgaggaacagcttgagcctcagttttttcctctgtaaatggggttgatagcagttctgacccagcgggctgttgggggagtcacagagatgctgggtgctgcctttgcactcagaagggtccaggctaggtgtggtggctaacacctgtaatcccagtactttgggaggctgaggtgggagaatttcttgagtccatgagttacagaccagcctgggtaatatagagacaaactgtctctataaatttttttcccaaaaattagccaggcatggaggtgtgcacctgtagttctagctgcttgagagtctgaagtgggaggataacttgagtacaggaggttgaggctgcactgagccatgatcacaccactatactccagcctgggtgacagagccagaccctatctcaaaaaaaaaaaaaaaaaaaaaatcaaaggggtccagcagcatcttcctgtcagcttacctaagggagcatgataaattgagtccctgccacgatggacatggggagtgtagtgggagggaatggcaaaggcaccacaggcagagggaacagcctgggcatagtggggggtgtgatgtggcacagcactgattgtgggaagcgagggatgtgggagatgaggcttcaggtagtcagagggaggttgaggcaaagcctcacctgcatgctctagatgaggtccaattcctggtacccagctcctagcctagtaatgggccacttctcccagggccacagttttctctcctatcaaatggaacatgttagcactgctctatggtgccaatgaagggtataagtgtccagtgcccatttcctgccccagcaaaggcactttcttttccttgtcctcttgcctactggggaactccttccatccctggttcctcccccagcttctgcgaggcccctcctctgagcccccacacctcatcaaaccctcaacaccgtctggtgttttccttggtgcctcttcaagatgctgtgagctccttgggggcaggtggtgcctgtgtacctcttttttttttcttttttttttttttttgagacggagtctcgctctgtcacccaggctggaatgcagtggcgcgatctcggctcactgaaagctccacctcccgggttcacgccattctcctgcctcagtctcctgagtagctggtactacaggggcccgccactgcgcccggctaattttttctttttttctttttttttttttttgagacggagtctcgctctgtctcccaggctggagtgcagtggcacaatctccgctcactgcaaactccgcctcccgggttcacgccattctcctgcctcagcctcccgagtagctgggaccacaagcacccgccaccacgcccagctaattttttgtgtttttagtagagacggggtttcaccgtgttagccaggatggtctcgatctcctgacctcatgatctgcctgcctcggcctcccaaagtgctaggattacaggcgtgagccaccacgcctggccttttttttttttttgtatttttagtagagatgggctttccctgtggtcttgatctcctgacctcgtgatccacctgcctcggcctcccaaggtgctgggattacaggcgtgagccactgcgcctggccctgtgtatctgtttttctggaccgccatcatgttcaggaaggcatcgaatattttgtccgcgactgcaatcacacactgcatcatccctgaaacgaggtttccacggataaggtgcagcaacagagagagaatcctagcaactttcaatcattttcttttgaaatggttttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctctgtgtctcctactcccttccaatatgtggtgactccccagtctgtcaatgtcttttgtgactttgacacttttgaagaacagttattttgttgaatgtcccctaatttaggtttgtctgatgcttgcccatgataagactagggttacaggatttgagggagaactccatagagtggatgtgccctttctttttttctttatcatttttttgagattgaaactcgctctgtcgcccaggctggagtgcggtggcacgatcttggctcactgcaacctctgcctcctgggttcacgccattctcctgcctcagcctcctgagcagctgagactacaggcgcccgccaccacgcccggctaattttttgtatttttagtagagactgggtttcaccacattggccaggatggtcttgatctcctgacatcatcgtgatccgcccgccttggcctcccaaagtgctgggattacaggcgtgagccaccgtaaccagcctgccctgcgtaatttttgttgtcgatgatccaaagtgcacccactcgccatctctggtagctgggaggagcaggtttttgggtgaaggtgaaagagccggagttggggatgtgtgtggctggggggtacaggtgcgaccactttgcagtccactcctgtgagtagggcattcctgagggagagaaggcctggttagccctggggctccttcaaggcctggccccaggccttgatacctagagcagcctgacacatgtgtggatggactgccaggcggtccccttaggaggggctgttctagcagggaccctggcttgggtgaccaccacctcctgccacactccaggatccctgtccctgctggaagccgggcccagggccatgccagccgtgaggggttcctcatgagcctcctccccgggacccaggccccatgcagctgccccctcccacctgcctgacccccctggcctgcacttccctccatccgaatcctcaatctccgcctggaattcccttccctcctcaaccccacctggaaactctcctcctcctcccacacagctgggactccctttctcccacctctgggggcccaaagctctggatgccaccctagccctcagctggcctcacctgtctcctcatagccccacagcttgatggtgtctgtgtgggcagcgcctcaacgtgccaggtcaggctgaggttgcctgaggtgttggcggtgccgtagtattgccaatgcatctcgttcatcaactcactcttctccttcatcaacactttgttggggtgcactgggcaggggaggtgaggggtgagtgagggctgggcccagggaagcagggaggaggccctgaggcttcaagggctgtgggagcctccagggccaatgcatggcagcagctgggtgatggtctctccggccctcatggcagaaaaggacgctgaggccggagaggcaggggcctgccctccctccactgcccacgcctctagcctccacctggcttctcccctgccctggtgtggcggagctcagtggataggcactggcccacctctctagggacccctgcagctcccactcactctgggctgggaccgtggtctggatgccagggagtggaaaggagctgaaggaactctcgcaggcgggcaggcctcccaagggattggttcagccagagaggcaggacacggacgggccaagtctcggtgtgcatagattagcgctggggaaagtccccgtgggggcaggctgtgggcagggaggagggctcaccagccagccaagtgcccgcacgagggaaggagtggccatcgtccagtgagatggtgaaggggacgtggccgctctcatagagcaggggcgacacgaagtgcacttgcccggaggagtccacatggccgagggtctggatgctctcctgtggcatgcaaacctgtgggcctggtggtggtaggaggtgctgggccactgcaggctgagcatctcgacagtctgggcccccaacctccctggggaacccatccaaccagctgtcctgtgccctcctgcctgtcctgggtctgaggggctccattcagcctgccagtgggtctgagccctcagcatgcacagggatgggggcgtggggccccagtgcccggcctcctgggcctcccaacctgcagatcacactggtgtctgtggggctggacatcttgaagtgccgcaccacaaagtccttgccgcccatcatggagactgagtagggcaatatctccaggcagaagtcctggaaatccaagcagcaggtaccaaggccggagcacgtcgggtggcaggaacatggcctgtccagggcgccacagcgcatggagcagctctcttgggcatctggaggagaggatgctgagggcctggcctggcgggtgctggactggctgccccatgtgcagggcctgtctctgtttctcccacagcccattagacagcagcatccccaggaaaatgctggccgggaactgcacaggccaccacgttgatatggtagaaagtcacagggcccgtggggatgggatgaatcttagcatagaccatctggctgttgccctgactgatgggctagaatgcagcgagaagaggcaaaaggctgcacccgctcagccctgcagggtcaggagaagccccctgggcatgactgcccttcagccaccaagtcctctatcccacaggcgggggtcctcagagggccacggtagctggagccctcgacctctcttggctccccagggtgtctgtgaacagtgcgccttctgggggccctgaagactgcagaagaaccccttttgcttgcctggactggggtgggggatacagctgccaagagtcccattcgaggcctggtagggaatggtgcagggtctgaacttgacccttctcactctcccaggggctgcaattgagaccccaaagagagctccgccctcagggcagaaggccagggctgctcccctcctttctggggggaggagggacatttcaagcaggtgtcccagcagtggggaaagggaagtgggggtgcacactgcgaggggctgtgggtgctgggcccaaagcatctcctatgggccatgacacccacggcagggccacatttccagggactggcatggaggaagagttgcagggagggactggggcaggtgcgtgcccagctgggggccctgaagggagacaggtcccatccccgggctccagagatgccaccacccagggaagccttggctgtcccagccacacctaatcctgccgctcagagtttgcataatttaatcagtgttcacctcccttcttgagcagatgaggaaactgaagctcagatgcggacaggcaaggccgagccaggcccttggtggcttctgggagcccctgcagccagggcgggtggtaagggctgtggcctgggactggtcacttgggccctgccacctgggctggacgtccagacaggcgggtggtcctctcccagctgcagcttctcaaggtgtccaaaagggacccttgccacacttgcagggagtcagagctggccccagggcatgagcttaggccatctggtctgtgatctgccccagcgcttgcggccaggccagcccattgttccccagcctgttctctctcttgcctgggtggtgcctgctgggaaccacagggtgttggcagccacccatggctccagagaggtgggcccctactgaaagtgttagaggcatgtgctgggggacttggctcctgagtccccacacagagctgttccagggaagccacacccgcatttgatgtcttcccacctcccaaagacatttggtgagaggcccccaagaccttcagcttctcaggactgtttccagaggggagaaagtcccttaacccacaacggtgctcagggtacctctgcaggtgagtgtcctgtaagtggatgctcaggcgctgagccacggagagcctgtctcctggccccaggctggcgagggcattcatcccaggcccagggctgaggttgctccctacagcactgggtgcaggtgtccatcctcctgtaggtgaggctccgggtggttcgtctgagacagttcccaggaactggaggagggagagctgctgcttcctgtttctggcctgggaacccttgctgtgcgtgtctggagacgatggaagtccggtaggggctaggtgtgcagtctgggaagctccataccacaggccctgccgtcagctgagtaactgaggctggctcatctcagccccccaaaggtgggttcagccagacccatatggggccgccaagcctctggttccaaaagggcagtgcccagccctttaggcctttcttcttgggtggtgggtgtgtccagcccatgaggggcacagggcagtgaggagggtccccatctccatcctggacagagagcctgctccatgggaggtcccaggggccaggagggcccctgtggtgctgggaggggaagagagttgtgaagggtgggtttgggtccctggaacctgtgcatccccaagacagatgggcctggagccttcgggggcggggccagctctaggggcttgtttaatgctctgtggtggctgccttaaaatacttaatcatttttggtcaggcacggtggctcaggcctgtaatcccagcacttcgggaggcctaggtgggcggatcacttgaggtcaggagttcaagaccagcctggctaacatggtgaaactccgtctctactaaaaatacaaaaattagctgggcgtggggacatgtccctgccccctgccccttgtgcccgccctctccctccccctgccccttgtgcacaccctctgtaccccccttcccgccccagcctgtgtttgcagtgctacagggtggctgcagccttcgcctcccacagctcctcaaggtcagagggctgggaacccctgggatgtggctgggatgaggaccctgcccctcgtcaggcatttccaggcaaggggcacagagacacagccagcccagcagctgagcccctcctatcaggccaggtgggaaactgaggcatgaacacaaccccagactggaaataacaaagccatcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactagggccccacacaccaggaggaagaacccagtgcagagagtgccagcaggaagccacaggggcagggaaggcgctcctgggagggtgggtggctgcgtcctgaggctgagcagggggagccggcctagggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgaggacactcctgacacagagaccccagcccagctggcaggggaaggggagccctcaaggacccctgtaggttggggcatgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcggaggttgcagtgagccgagatggcaccactgcattccagcctggtgacagagtgagactccgtctcaaaaaaaaaaaaaaaaaaagaaaagaaaaaaagaaaaatgacacttgccaaagcgccgtagggaagactgtccaggaccgtgtcactaggcataagggaccacggcgatgagattctgcagtgggtaagagactgggctcagcctcgaagacagcatgggcaagtgggatcggaccgtcaaggagcagggggaagactatccaggaccgtgtcactaggcataagggaccatggcgatgagattctgcagtgggtaagagactgggctcagcctcgaagacagcatgggcaagtgggatcggacagtcaaggagcagggtggggggcagtgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcagaattcttgctaaaactagagtttataaggaagtgctcagatgtgcctaggagaaggctcaggagcctaaataaagcttgaccaagcagagaatctttgtcaccagcttggtgagagtgaggcccagagtgggtcagggcttacctgctcaggttgtacaactgggaggggtccgtcaggagcctggagtcttcccactgggggctgagtctgggccctcagggcacatataggtagatgctgtcaggcccgacaccccatgcagtgcagactgggatgctggtgcctgtggcacagactggtcagacccaccccaggctagacattccttgcagggagagctgaggctgttgatgccaggaacagacaaacaaggtcatcaccaggtaatgagctcgttacccacatcaggcaaggccattgctgggtaatcatttggcctcctgcagagccacctgccctgggacggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtcggggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctctgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacagggtccccaggaccccgctcccattctgcccttgctcctgccaacctgtcttctctatgcccatgactttgggaccctctgccataagtaccagcccccacatctgtagcctctgcaggaacaagccctaatctggactcattgcaatggctcaggttctcttccagcctgtccatagacctccaggcagagatcacaaaactaacagctctttctgcaaatctggactctctcctgcaccttcgccaccatccaggcctccctgtcactcctcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcagagccagctgctggaggtcccagaggacgggtgactcagcaggaatgggggagtctgaggggttgacagagtgcccaattctcacctcctcctgcaccttccagggagacgagctgcagggagtgattgagtggatgaacatgactagagggacccagtcttctcctcagcagctgcttgaggacagtattagcggtcccctcaatcccccccccaacacatgcacacatgcactgatctgcaggggccagaccccagtggacccggggacacagcttccaggggctgtcttgccatgtcccttcccagacctgcctggattcatgccaggccaccctccacaatttgctgagggaggccccagggtccagggcacccagagtgctaactagcccctgggggtacagggagaacagcatgctgtgtgggggatactactctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggaggggctggccagctcctctccccagcctcctactgtaaaatgggagaggatcccagccctgctgattcatccactcactccatggcaagacagccactgacagctgtgtcctggggcccacccgggcctggcctctgtgcaggctagcactcagcatgcttagtgccacactcggcccaggagaaatgacccagccctgggctcagagaccccacagtgggtggatggaaaacagagtcatttaaatacaactgtgaagggtgctgtggaggaggggctcgaggtccccagtgtgggatggggtggtcatggaacatttccctatctaagtgggaaaagtgagagccaccaggaaaatggcaggggttggggggagaggaactgtgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatcactacaaaataaataaataaataaaataaaataaataaaaataaaaataaaaaaagccgggcatggtggtgcacgcttgtagtcccatctactcagcagactgaggtgggaggatcgcttgagcccaggagatggaggctgcagtgagctatgattgcaccactgcactccagcctgggcaacacagcaagatcctgtttataaaaacaaaacaaaacaaaaaacccagcttgagatggccagggatttccagaggccctaggcgggccaccttggagagtaagggagaccctgaagagctcgcatggaaggaccagcagcttggggctggagatgccacctggatggattcctccagctgtgtggactaggggacagggtgaggagataatggcctggactacatggaaggacgtcgccctgagccattgaaaagggctgtggggtccatgaccactcctggccttcccttgactatgatggagacagtagcttctagtgtaaaatgtgagctcagttcctgactcgtgtctagcgggtggtgcctggtctttggctggcgatgctccatgtcacctatgcccagaaactgggccatgccctttgtgaggacctgcccacaacgtcgttgttcccgcagggtccccggggaaccgggctgcccgggacccagccctgccagggttccctgcggcccaggccggaacccccagggctttggtcgttcccaaagccgtcccgcgggccccctccacggtgcgtcgcctgggccccagcgatggctaggctgcagcctggggctcccggccatcccgggcgctggcggcggtggaggcagcagggcggatggcgacgcccggccgcccgtgggcccaggcgcgtagtgcgtacagagccagcgaggtgctgcggcgcgtcacgggccgccggcgggacccggggccgcaatccaatgggccgggccgggaagacgcccgagccccgggccggctggctcgcctgctccgccagctccgggccgaagcggcttcgcggtccgaggtgccgcggctgctgaagctggtggagcgtgcgggggccggggcggcgggcgcgggcgagaggaccggcgcgcacagccgcggctccgtgtgctcagtatgcggggagccccgcggcagggccacctacccggcgggggtcctggaggtcagcgagcggcggctgcaggagggactcgcggcagtgcgcgaggagctgggcgccgagattgaggcgctgcgcgcggagcttcgagcggagctggacgctctgcgcgcgctgctgccgccgccgccgccgtccccgcctgcccgccgcgagccccgcgccgtcccccgcgccgcgccccgcggcccgaccctgctgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtgtagcgtggctctgagtcagaagggtgcccgggtgccgccagttagggctccggtactggagggagggggtgggcgcgggacgggcggagggtgggccacgtgcgtctggggagtgcggatgggagccggggtccttgcgagagactgagtccggctagagaacagggtggagcccctttggaccttagagctgggcctttgggccttgggtctgggtcagcctttgggccagggctgggtcagcctccaggggaacagccgagactcctcttccttggggtgactgcacgttctttttctttcaaggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggaggcactggggcatggcttcagagcaccaggcagcgctccgcggtgcccagcacccgctcagccagggcagcctgcagcggagcctggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcagtgggggaccgcgccgggtcacgcacccaccccctccaggccacattaggctaaggtcactctgtgcattatttcattatttcacacggagggtcgcccacggttgacagaaccacaagctgagccccaggcgcatcagagcgcagtgcacacctgctagggtgggggaagagcggggggctgctgcggggaccgaggctctgggggaggccaagactgtgtgccccttaagaggctgctgtgggccaggcgcggtggctcacgcctgtaatcccagcactttgggaggccgaggcgggcggatcacgaggtcaggagatcgagaccatcctggctaacacggtgaaaccccgtttctactaaaaatacaaaaaattagccgggcgtgatggcgggcacctgtagtcccagctactcaggaggctgaggcaggagaatggcatgaacccgggaggcggagcttgcagtgagctgattccaccactgcactccagcctgggcgacacagcaagaccccgtctcaaaaaaaaaaagaggctgctgtgggcggaagttacccgtgagcggtatggggtgaaagtgggagggtccagcctggggcacggtgtggaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagtgacccagcgaagcgacagtagctcgaggtgttgggccgcatcgacgccagcaggaaggtggacatcagattcactgagagccccaggcggcagagggagggggattggaaccagcctccccgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcaaggggttctgagtgggggagtctctgaagagggaactcagctgggatactctaagcaggaggctcccagtggcaggaggcatctggcatctgggaaatggggtggagggttctcgccgccactggccctgccgattcaggcattcccaccgccctatcctcccacagatcctatagaccctagagatccccccatggactccacaggcctagcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacatgcatctgggggtaggcacagatgtgggagatacccagctgcccccaccttgctctctctcatctccgtgggagcactccggccaccccaccttgtgcccaagtctacctccatagcctggcgctgcctgtccaggctgtgctctgagtctgctcgcctcgggccccccccccgcccccagctgatgtgcagccgcagtgcgcggtagacaggcaacagcagcccagcctcccaaatctccaggtggttctgaggatcagtgtccattcagagtagcaatgaaggggaggaggcacacgacaccctctctacctcaccacctgcccaccttgtgccattagagcacagggtacgagcagaggcccttcctcaggccaggctgctccccagtggggccccattgcctccatggaatggaacccatggtgtccatggctcctgctggtcagcagagcagagttccacagactgcaggggaaaccctcccccacacacccagcatggcatggaagaaggcagagggcagccctcctggggtggggctctgagcccagctgtgtgtggtcagggatcctggccctgccagagaccctgactcctggtcctcaggggccatggctggttgtgatttgtagggtgggacctggcacctacacagagggcgcatctggactgctgtgtgaggatgctcctttcctgtgaagctagcccctgtggagggtttttggccctgtaggatgtctcagctcccgtgtgtagggggtcctggtccctgtgtacactcaggagctctcatgccctgtgtggggctcctgctcctgcctaggaggggtcctgaccacagggtgctgacctgtgtggctgtcattctccagggtccaagggcctggaggtgctgagtcatagcctcggaagatgaagggccctagggtagagttccgccggaccctgtgaaagtcaatgtcgatgagggactggcctgggcccccacaggcaggggccagcttcttccagtgggtggggactgctggaacaaggactggggcctttggggtgggggtggggtcagggaggcagcctgggggtgcagcagagagtggcccccatacacccagaggatagcccagcctcaggaaacccagctccctgcttcccccacacctgaacaggtcacagcatcccccttctcttgtaccctgcatctggcctatccatctagtctcccggttggctgccccatggtgagatgaaggcaaaagagtctctggcacacagttgcacacccacactgggacctctatcacctgcacacacttgggctggccacagtaacaggcacaccagccttgactgactcgggaccggcgatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctcactcagcctcacatgacactctgtcctcaccacacttggggtcctgggagtcgtagcaccaggcacctatagagacagtgggcaggaggctgagctgagagaccagtcatctgggtcctctccaagccccatcccatcagctggggtccaagaatgaagtaggccaggggcttaggccaggggaggccagtgaagaaccttctctcctgtcacccctaccccagtattttctctccccagtccctccccactcccagtggcaagacctaaggggtggtggagcatggcaagagggtagattggagaccagacgggaagagtcctggtgctcactctcagagtctgcgccacaccagctgcactgcaaggcgagcatgatgccaggggcgtgcgtggctcagtggcagccgcagctaggaaggactagaaagtggctagacctcggagccaagatgctggcctggctactacatatttattcattagctagctgggctaggggcgtggctattgaggagaggatgggaggggtcggtgcccaggcagggccaccaggaagagcgcgagcgctccaaactcacccaggtgtgctgtggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgctcatgactttcggggcaaggatgggaggaaggtgtaggatgtctcttgccccactgtgggcctggaactgccaccccatcccaagaccacagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctagaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtcttgaatgcttgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtctgtggtcacacagctcaggtcaggtatttattagtacatgaatagcttagctgtgtcatagtctttatgtgaaaggcacataaaaggcactttggcaggctcaaagtgtggggattataggtgtcagccaccgtgcctagcccactggatgacttatgatatcatatgtgacattgtgacatcatgtgagtcagggatgtaccccgttctcagctgctatatgctatgttacagtgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcgcctgaggcaggagaattgcttgaacccaggaggcagaggttgcagtgagctgagattacaccactgcactccagccttggggacagagtgagactgtatctcaaaaaaataaaataaaataatctaggacaaccaagagaaggactcaggctcaccttactctatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgtgggcctgattcacagtgtatgtgagtcacaaatgtcacttatgacaccatacagcaggtgagaggggatagtcattattcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggaggtgcagacacaaatcacactgtgtgctgtatcccatatatgtgtttaatttctgtgtttaagagagctgggttcatgaatgaacgtagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgttcactgatacatatttgctccgtactgaagtgaggcagatgcatgagtgattgagaataatgctaccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagcatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccaatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccaggcacagtggctcatgtctgtaatcccagcactttcgggggccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaatcggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttgggttttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggctggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccccaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagatgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagagtttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaagtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggcggaggttgcagtgagccgagacagcaccattgcactccagcctgagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaatatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatgtatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaatgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttctgtttttttttttttttttaattatactttaagttctggggtagccgtgcagaaagtgcaggtttatcacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctgattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagtgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcacttcaaataatgtacaaaatctacaaaaatcatatttaccaggacacatctgttaaataaaagcattgtttcgtgttggtatacatatacacaagactatgtataacagactgtttcccctccctgcaaccacagaaccatcacacacaggcacagatacacgtcggctatgccgctttccacgaatgcatggaacccaggacgcgaacccacagctcgaggtcttataccttcactactgagctgccgccactgcagcagcaacacctctgcggaggtgtcgctgaagtcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacagggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacatttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagctgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccgcccctcatggcccggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgcgtgttttctgcacctggtacagctggatggcctcctcaatgccgtcgtcgctgctggagtcggacgcctcgggcgcctgtacggcgctcgtgactcgctttcccctccttgcggtgctggcgttccttttaatcccacttttattctgtactgcttctgaagggcggtgggggttgctggctttgtgctgccctccttctcctgcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttggttctcatgctgtcttttctcattcagaaactgttcgatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttccggcttacatctactgcctccgcctgcagccctggaaggctgtgcatggctgggccccgctggccccgggctgtgcggctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggtgggacagaggccacccatttgcgctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggagagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcgctgcaagctctgcctcccgggttcaagtcattctcctgcctcggcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggttgctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctagaaagtccataatatgtttgacccacttcatggtggtgtcctataaatcccaaaggtttttactttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgccatcaagtgatctgcctgcctcggcctcccaaagtgctgggattacaggcgtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacaaactttcattaatgtctatgaagaagcaaatacctcttcttttcttttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggccaatttttttgtattttttgtagagacagagtttcaccgtgttgtccaggctggtctcaaactcctggcctcaagtggtctgcccgccttggcctcccaaagtgctgggattacagttgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggcttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggcatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttccctttcaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccacataacacatcacaaattaattctcaataggggctgggtgcagtggctcacatctgtaatcacagagtaatttgggaggctgaggcgggtggattgcttgaagccaggagcttgacatcagcctggccaacatggtgaaaccccatctctactaaaaatacaaaaattagctgggcgtggtggtgtgtgcctgtgatcccagcttcttgggaggctgaagcgtgagaattgcttaggagcccaggaggttgaagctgtagtgagcagagattgtaccactgtactccagcctgtacttcatgacaaagaaaatgtaccattgtaccactgacagaatgagaccctgtcccaaaaaaggaaaaaagctcagtagatttaaaatgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaagtcaggagttcaagatcagccaggccaacatggcgaaaccctgtctctactaaaaacacaaaaattagctgggagtggtggtacgtgcctgtagtcccagctacccagcaggctgaggcatgagaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgtctgcctgtctatgttttagagacaaggtctagctccattgccctggcaacaatcagatgcaaccacaatcagtggcacaatcggctcactgcagccttgaattcctgggctcgccactatgccagctctttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctcatgcctgtaatcccaacactttgggagcctgaggtagaagttgaggtcaggaggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccagccgggcatggtgcctcacgcctgtaatctcagcactttgagaggccgaggcatgtggatcacggggtcaggagatcgagaccatcctggctaacacagtgaaacctgtctctactaaaaatacagaaaaattagccacatgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcacaaaaaaaaaaaaaaaagaaagaaagaaatatagcaaaacacaacaaaaaaattaaaatttgctgggtgtagttgtgcctttagtctcagctactggggagggtctgctggaggatcacttgagcccaggggttcaaggctgtgattaagccactgcactccagcctgggtaacagagcaagatcgtatctctaaaaaaaaaaaagaaaaaagaaaacactctctggccacagatgagagaaggcagacaggaagccagtaagccaagcaggcagagggcaggtggccccagcccagctgtcgggtggtgagcagtgtcagggagacaggagtgccggagctggtgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagctccatcctccacgcagtggtgcagccccatcccagcgcccattcgagctgctgtcccattgcagggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcctgaggtgtgtccctgcgtcacagctcaccatgtcctgaaggaggcagtgcagagcaacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcaggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggctcactgtgggtgtggggcctgccgtagaggcatcaggtgggctccccagggtggctacagcctcacatatgctttatgaatccattcctgccacagaatttgattgcgggcctactgtgtgctcggatggactcgtgggtgacccccagtcttggcttctgccccacagaactgacagtgtggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaacgcttcccagatgccaccctcagccctgcaccacctgacccactcacccagtagttgccccagctccatgctgggtccctataagaccctgtcatatcccttcccgctgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctaaggggacagagccactgcagcgtgtccctctgccctcctttttggctaaggccaggtccttcatctactcgctggctcggggtgctgttcctacaatgctcctgtctgcctctgatgatttatttctttatcacggattattcccaaaaaaaaggcagctgttattgctctagagacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaacccaaaactgcccaagcatcaatgttcccttttcctggattctgcagtgtggacatttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactgtcttcccacctcagcctcccaaagcgctgggattacaggtgtgttttttctttgagacggagtctcgctctgttgcccaggctggagtgcagtggcgctatctcggctcactgcaagctccgcctcctgggttcacgccattctcctgcctcagcctcccgagtagctgggactacaggcgcccgacactgcgcccagctaattttttgtatttttagtagagacggggtttcaccgtgatcgcgatctcctgacctcgtgatccgcctgcctcggcctcccaaagtgctgggattacaggcatgagccaccgtgcctggcctgttttgttgatttttaaagcccagggcagtagtcttggaaaatgtcccacatcgtggatttgcctttctgtttccttgagggcagattcagacagaacacctttccctgggattggtcagctaatccgtggggtgttgctgaaactttattttattttattttattttattttattttatttttgagacggagtctcgctctgtcccccaggctgtcccccaggctggagtgcagtggcgggatctcggctcactgcaagctccgcctcccaggttcacgccattctcctgcctcagccccccaagtagctgggactacaggtgcccaccaccgcgcccagctaattttttgtatttttagtagagacggggtttcactgtgttagccaggatggtctcgatctcctgacgtcatgatccgccctcccaaagtgctgggattacaggcctcggcctcccaaagtgctgggattacaagcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatgcttgattcttctctttctcccacccaggccatcatctcttgcctggttgatacccacagcctcccctttgggctttatccttatccccgtcatagctgccagagggaccctgtgaaaacactccccagcctcctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcctgtggtttcagcactttccctgtgtgtgtttgtttttcttggcatgagggcaggacttaagtgtctgttccctgttgattccccagtgccaggcatgcagtgcaaattctagaaatattttttgcatgaaagaatgagtgattgaatgcggcaagggtctggaggctgaggaccaggcagacagacattcagagttgctggaacgcgacagagacagggagtcagactggtcatgcaaggtcctgggcctgcccttgggtcctggggagccacggaaggttgtgggtgccagagggttgcggtcagagtcacagtcaagggccttctgagacctgtgccccctccccacctcctcaggccagctctggggtctcagcaggtggtccgcaacatgacctctgagttcttcgctgcccagctccggtcccagatctctgaccacaccactcacccgatctcctacgacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcatcaccaatgagtttggggcacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctcttgtccatgtgcccgacgatcatggtgggccaggacggccaggtccggatggtggtgggagctgctgggggcacgcagatcaccacagacactgcactggtatgtgtcaccccttttctccctggccctgcccactctgcacagcccccaagccacgctgatcacactcccatgccccaggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgagtgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccactctctgggcctcagtgttttgtgtgtgaaatggagccatctggctggggaggaacagagaggtgggattcggagatcttcacaatgcggacactggaactagcctcagcatcttcagcatggggagagccaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagccgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccggaaggaaacagctcgacacagcagccttcaccatcggcagcccctccaggcctccctcggggcctgctccctcctctgtgcacagttccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtagccactgcacccggcctcaatccttatattggcctgagaggaaaggccgtggccccatttgcaggggagaagactgaagctggaggggcaggccttgctctgggttgcacagcaggaagagaagtgggagctggccacgaggcttcctggacccgaaatgctggtggggtacaccctggttctctaggtcccatggggctcagcccaggactacctcggggggtgagggacttaaatcgtctccttcattctcatcgccccttcccccatcatttcctgaggaaggacattcagggacctgaaggggtggcctgcccctccccacctgtgggtgtttctcatcagctgggacaagagactgagaaaagaaagagacacagagacaaagtatagagaaagaaaagtgggcccaggggacctgcactcagcatacggaggccccacgctggcaccagtctctgagttccctagtatttattgatcattatctctaccatctcagagagggggatgtggcaggacaatagggtaatagtggggagagggtcagcaggaaaacacgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagcagatggaatatacaatcaacactgagacattcctttgcccagggacgatcaggagagagatgccttcctcttatctcaactgcaaagaggccttcctcttttactaatcctcctcagcacagaccctttacaggtgtcgggctgggggacggtcaggtctttcccttcccacgaggccatatttcagactgtcacctggggagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctcgggcggtccctgcaccctggcctctgcctgacgaggatggtggggagaggagggggacgtcccccacactgctgtctccactgttcctgctgcccaggcctctgggcttccaggactgcagcgggtcggtgggtgggctggcctgagcccaggaatgcacttcagctcctggttgagcaatgtcactgaggcttgggagtcgggtgggggcgggaggaggcgtccgcaggcccccctaccgtgagaggcagccgtgggaacagcctacctctaaacaatcactgcagcccaggctggccaggggctctggccggacataggggcctggcaggctgtgtgccctgtaaggacacagtctgtctctgtgcctcagtttctctgctgcccagatggaggggcccagactccaggtgtagacatctggagcaggcagtgttcagttggggaggaagcggggaggactgtgggggccatgtgggaaggattccaccccacatcacctgcacccctgctgagcctggtcaacggagcccctcagtgggtcctcactcccctggttgcctcccatttaggcaccctgaggcctggggagaacagagccaggccagtgtccccagagaggctgcgctgccagcacagtagtagcggatttggattcagggaagcagacctgcagccagggtgggaaagagctgcaggtggggtggggcccccacatggcacagcccccctccctggaggaccatgctgcatttccaggacagcaagtcccagggatggatggtgcctggtgccaagggctagaggcatggtctgtctgcatttcccacgtaagtgtctcgtagtcactagcatttgatgctgtcaagaccccctgtcctctgtgcagactgggaagcccttggtcaccctgggggagttgggggacccaggccaggctgcagaagcataaggacttgaacccgggtcctgagtgacaccaccttgggtcctcctccttctgcctctgttcagctccaccttgatgctgactaggctgggccatgcggagagggttaggggatagagatgggagctggggagcagggctccactctgggaggggggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggtgggcggtaggtcgggcctttggacctaccagcagtgagggagttaacacagcagctgacttctctaggcaaagaaaactcccctcagacgctttgctgcctggcctcctgccaggaacaagcaggagctgaaaactagaagttgaggcatgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccatctgcccaccggcctcccctctccttctgggccgcagagccatggcccaggactacggagccatgggtgacctggtcctgctggggctggggctggggctggcgctggctgtcattgtgctggctgtggtcctctctcgacaccaggccccatttgacccccggcctttgcccacaccgctgttgctgctgactccaaggtcttctcaaatattgtacggtgagtgagacgtgggaggaagctgggtggcctttggcagccagcccctcctggagaaggcgtgtgtgtgtgagcatgtgtgtgtgtgagagattatgtgtgagtgtgtgtgggtatatgtgtgagtgtgtttgtggggtgtgggtgtgtgtgaatgtgtgtgatcgtgtttgggtgtgtgtatgtgtgagtgtgggtgtgtgtgaatgtgtgtgattgtgtttgtgtatgtgtgtgtgggtgtgtgtgagtatatgtgagtgtgagtgtgtgggggtgtgggtgggtgtgaatgtgtgtgattgtgtttcgctgtgtgagggtgtgtgtgactgtgagtgtgtgagtgtgggtgtgtgggtgtgtgtaaatgtgtgagtgtgagtatggggggtgggtatgtgtgaatgtgtgtgattgtgtgtgggtatatttgtgggtgtgtgtgtgtgtgcacgtgtgtgtgtgtgcacgtgcactggcccaggaagcaggagccgtgtgtgtgggcttcagcacctgcagggcttgagcgcaaggagacagcctcagggcccttgcacagaacaggcggcagggtgtgcccgtggggcagatggggacttggggacaatggtggtgtgtgagtccatacctggctccaggattcaggaggcccatttgcatatcccaggtgggaacctgtctggccccgcctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacacacaggatgccccttcttgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgttcattcattcaccttttcattcattccttcttccctccattcccccatctgtccatccttccctgccctgattgctcatgccacccccccagcccctcctgacctggtcctttggtttctcttcagggctttctgtctcctcccacagggctgagaatggcagctcagggacaagtgggggctggggactgcttagtctccccagtggctctcaggggatttgagggtttgacgtcagctgccaccccaggctgtgcccctcctctgctcgggaggacatacagagatgcgacacccacttaaactcgaagttgcaaagatgcaaatgagactggggtctcaggcaccagagaccacccgtgggcacgtggcttttgggagtggggacctgctgccacagatctctgaagagtctggacctgctgggtctccccgagtgactgtctgggggtctccatagcatgccctgctgtgtgcgtgacggtcactggttgggtaggggtctctactctaaagctccctctgccggcatcccctcgaactctcccttggtgaagagaggatgtggtttgccccagtgttttatcaaacaactctctccacttccagttttaagaagctgggagtggaagagagcctggggctggccccagctgctgctgtgaaacaggggtcactggacgctgggaccctggccgggctggctggaggcctcaggaagaggcctgctacagcgtcatcctggccaagattcctccctgcagaggaccctggccacgctgccacagggtctgctggggccaccagaagcccatgctcctgcctccatctctcccctctgtgctcacctctcaccaggaggccctcccagagttcagtgtcctgcttttttttttttttttttttttttttgtgacggtgtctcactctgtcaccaggctggagtgcagtggcgcgatctcagcttactgcaacctctgcttcctcggttcaaatgattctcctgcctcagcctcctgagtagctgggactacaggtgccagccaccacgccccgctaatttctgtatttttagtagagacagggtttcaccatgttggcccaggatggtctctatctcttgattcacccgccttggccacccaaagtgctggcattacaggagtgagtcatggcacccggcctcatctcctactctttcagcaccaggttttattcttgggattctgctacagccggagcccctgggtgcgagttcctaaggtttctgtgagtgtggacccagcaccgtgcctagtagacatacaaaaggagcatggtgacagtgaggtctgtcatctccagcataatgactgttttgatccttgtaaaaaaggtgatttttggctgggtgtggtggctcacacctgtaatcccagcactttgggaggccgaggggggtggctcacttgaggtcaggagttggagaccagcctgggcaacatggtgaaaccatgtctctactaaaaatacaaaaattagctgggcatggtagcaggtgcctgtaatcccagatacttgggaggctgagacaggagaatcacttgaacgcaggaggcaaaggttgcagtaagccaagattgcaccactgcactccagcctgggtgacagagcaagacttggtctcaaaaaaaaaaaaaaaaaagaaagaaaagtttatatttttgttctaatgcttatcttaatatcgtcattctataattatatgttttatataattataatagctatataagatataatacccctagtatgttgttttttggatattctacttgctcctgatggttaatttatgtgtcaacttggctaagctatggtgtcctgttgtttggtcaaatacttgtcaatatcttgctgggaggttatttcatagatgtgattaacactgacagtcaattgactttaagtaaaacagattacccaccataatatgggtgggccacctccaatcagttgaaggccttaagaacaaaaactgaggtttcccagagaagcaggaattctgcttcaagactgtaacacacaaaccctacctgagtttctggcctgctgactgctctacagattttaggttccagacttcgagatcaactcttacctgaatttatagcctgctggcttgccctacagattttaaaacttgctagtccccacaatcatgtgagccaattcctaaataagtctctctctatgtataatctattggtttagtttctctgaaaaactttcacattccagtttcctggatgttaagaattaccgaaactagctagtaacttctttttttttttttttttgagacagagttttgctcttgttgcccaggctggaatgcaatggcacaatctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtcccttacctctaataatacttttcttcttaaagtctacttcattaaaaatagttatgctgggcatggtggctcatggctgtaatcttggcactttgctggaggtcgaggtgggtggatcactgaagcccaggagttcaagaccaacctgggcaacatggcgagaccctgcctctacaaaaaatacaaaaattagctgggtgtggctagtataattctaagttggcacacttgtagtcccagctacttgggatgctgaggtgggagaatcgcttgagcctagaagggagagattgctgtaagccaagatcacatcactgcactccagcctgggagacagagtgaggctctatctccaaaaaaaaaaaaaaaaaaaaaaaaaaaaagttatacagctttcttggttagtacatgcatgacatatttttcatgatcttccacctctctgtacccttatataaaaggcattagttgggttttactttattttcaattattttaatttttattgtccttttaaatgtaactaatgatttatttgggttgaaacccaccaccaatttgttttccatgcctattctatttcttcttatctcctctcacatcttgttttggatttattatttttattatttaatttcctccttctctattagtttcataactgtgcagtcttagagttcttttaaaagatgactggattattttagagcttacaacatgcatccttcccttatcaaagtctaacatgagctagtactttttgttgtggttgagatagagagagtcttcctctgctgcccaggctggagtgcagtggagcaatcttggttcactgcaacctccacttcttgggttcaagcaattctcctgcctcagtcacctgagtagctgggaccacaggtgtgcaccactatgcccggccaatttttgtattctttttcagtagagacagggtttcaccatgttggccaggctggtcttgaactccggaccttaagagatctgcctacctcggcatcctaaagtgttgggattacaggcgtgagccaccgcacccagcctatgagttagtacttctatcctcttcctagtcagtacaagaaccttggaacaggaactaaatttacccccagtgacttatatgctaatatttttgtgtattttaaatatgtgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttccgtgcaaatcccagatatataactgtacccatacatatttcagtatgttttatttcttttaaaccccacaagatatcattttctatactactgtaattttataccaataacattcatttagatttacccacacgtttaccctaccctccgggtcctgtttgaaaatcaagcccatgctcacaggccaatttttttttcttttagagacagggtctcactttgtcacccaagctggagtgcagtggtgcgattatagctcaatgcagcctccaattcctggactcaagggaccctcctgcctcagcctgccaagtagcttggactatagctgtatgttttattattattttgtagacatggggtctggctatgttgtccaggctattctcaaaattcccggcctcgagcaatcctcctgcctcggcctctcaaaggttgggattacaggtgtgaggcaaggcacccagctcagccacagagccctgttgcatctctcttactaggagcaagagctgactgccccctcatccccattccagagtgttggggctgtgttgagccgaggccaggccactggcatggcccaaggaacgggatcattcactgctgccccaaatctgacatcattccaccttgacaagacttcctcatccaatccctttacttgacagctggggaaaccaacgcgcacagagcacccccagctcactcggggtctcagagctgatccatgagcagaggctgagatcctgggatcttgtcccccagccgccctgcaagcttactccctttctgctggaagagatggggccggacctcaaccagcagccctggcctggacatgactgtgctcacccaggtattgaggccgagatgccccggcatcatatgtttttctcttattttttctttttttttgagacagtatctcactctgtcacccaagctggagtgcagtggcatgatattggctcactgcaacctctgcctcccgcttaaagtgattctcctgcctcagtcttccaagtagctgggcctacaggcttgtaccaccacgcctgactaatttttgtatttttactagagacagggtttccccatgttggccaggctcgtgtcgaactcctgacctcaggtgatccacctgccttggcctcccaaagtgctaggattacaggcatgagccatggcatcacttaaacgtagtgagaggccgggcaaggggctcatgcctgtaatcccagtgctttgagaggacgaggctgtcagatcacctaaggtcaggagttcgagaccagcctggccaacatggtgaaactgtgtctctacaaaaaaatagaaaaaaaaaatccctgcgtggtggcaagtatctgtagtcccagttactcaggagtctgaggcatgagaattgcttaaacctcggaggcggaggctgcagtgagctgagatggcgccactgcactccagcctgggtgacagagcaagactttgtctctaaataattaaataaataaatatggccgagcatggtgccttaggcctgtaatcccaacattttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcgcttgaacctggaaggcagaggttgcaatgagccgagattgcaccgctgcactctagcctgggcgatggagcaagactccatctcaactaaataaattaataaatacagagcaagattccatctcaaataaataaataaatgtacacctgtaatcctagcactttgggaggctaagacaggtcgatcacctgacgtcaggagttcgagaccagcctgaccaatatggcaaaactccatctctactaaaaatacaaaaattagctgggcgttttgacgtgtgcctgtagtcccagctacttgggaggctgagacaagagaattgcttgaacccaagaggtggaggttgcagtgagccgagatctcggctgcacttcagcctgggtgacagagtgagactctgtctcaaaaggaataaataaaatacaaagtaaaaaaaaatgtagtaagattgcagagtcgtgccgcagaagcgtgctggtcctatccatgtagtgaaggctgatttcatacacaaatgtcacaagaacttttcttttctttttctttttttttttttttgagacggagtctcactctgtcacccaggctggagtgcagtggtgcgatctaggctcactgcaagctctgcctcccgggtttatgccattctcctgcctcagcctcctgagtagctgggactacaggcgcctgccacctagcccagctaatttttttgtacttttagaggagatggggtttcaccgcgttagccaggatagtctcaatctcctgacctcgtgatccgcccgtctcggcctcccaaagtgctgggattacaggcatgagccaccacacccggccttcttatatgcttttattgcatttgagcgtacctcttttacagcgaagatctttttttttaattttattttatttttagagatggagtcttgctttgttgcccaggctggagcactgtggtgtgatcatagctcactgcagccttgaactcccgggcacaggtgatcctcccacctcagcctcctgaatagctgggactacaggcatgcaccaccatgcctggcatattttaaagatgtttgtagacatgaggtctcgctatgttgccaggcttgtctcaaactactgggctcaagccatccatccatttcagcctcccaaagtgcttggattataggcatgagcactgcgcctggccatcacactgtttttttggttgtttgtttgtttgtttgttttgagatggagtcttgctctgtcgctcaggctggagtgcagtagtgggatctcacctcattgcaagctccgccttgtgggttcacgccattctcctgcctcagcctcctgagtagctgggattacaggcgcccgccaccacgcctggctaattttttgtatttttagtagagacgggatttcaccgtgttagccaggatggtctcgatctcctgacctcgtgatctgcccgcctcggcctctcaaagtgctgggattacaggcatgagccaataaatatttttataatcattaactaccgaggagaagctggagagaaaaaaggtggatgaagttaaggcagagagactttgtaagtttcttggctgagcttttggagactgtatatcagagatcctatttgaggtgattttcagctacagagataggcctggtcatttgaaaaataacggattaggtgaagcttgcgtttgaaatcctccttctacttttcatctttctctcttgtttattctgagcatccatcttagacacccaatctttgtcactttgtggttgtcattgatttccctgttattgagattagaggttggcagactttctctgtaaagggctggagagaaagtacttcagactttgtggtctgtgcggtgtctgttgcaaccacttaactctgccctgtagagcaaaagcagccgcagacagtacatgggcagatgagcatggctggggtccagttacatttacttgcaaaaagagggttggagactgggtgcgatctcccacctttaatcccggcactttgggaggccgaggcaggaggatcacttcaagccaggagttcaagaccagcctgggcaacaaagcaagactccatctctacaaaaaaataaaaattattatagctaggcatggtggtacacacccgtagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcccgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaacgaatagaaacatagtgcttaacttcccaggccacctattttgttcctctccaaggtgatggatagatgaaggccttatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcggggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggcttgtgctatagaaattcaaaggcaagggaagtcacttctgttgtggggccctgggaggagcctccaggctggaaaggcttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattccatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgctatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctcaccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagtccactgggctccggctgtttccatcacatggagaatgactcagagcctggcctccagccaccctcctggcctttctgcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacctccgaatgcaccactcttccattatatccagtcaattgctggttaccttgggcctacaactgggggagggcaggggctgctggccacctcctcatctacagtaagagtcaatgagcagttaagtggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccaatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatccataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtcctcgttagcatgccttgtgggtgtcattagcgatgtcatatacagcatcctcattggtgatgtcttatatggtgtcattagcgatgttgtgtacagcgtcctcgttagcaatgccttgtacagtgtcctcgttagcaatgtcatatacagtgtcctcattagcgatggcttatacactgtcctcattagcgatgttgtgtacagcatccttgttagtgtgcctcgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttttttatatatactttaagttttagggtacatgtgcacattgtgcaggttagttacatatgtatacatgtgccacgctggtgcgctgcacccactaactcatcatctagcattaggtatatctcccgatgctatccctcccccccccaccccacaagagtccccagagtgtgatattccccttcctgtgtccatgtgatctcattgttcaattcccacctatgagtgagaatatgcggtgtttggttttttgttcttgcgatagttactagcgatgtcttatacggtgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagtgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgtcgtgtacagcgtccacgatagcgtgccttgtcggtatcattagcaatgtcgtataaagcgccctcattggtgatgtcttgtacggtgccatcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcaatgtcgtgtacagtgtccacgttagcgtgccttgtcggtgccattagcaatgtcgtataaagcgccctcattggtgatgtcttgtatggtgccgtcattagcgatgttgtgtacagtgtccttgttagcgacggcttgtagagtgtccttgttagcgatgtcatatacaacgtcctcattaccaatgccttgtatggtgtcctcattagcgatgtcgtgtacagcgtcctcgttagtgtgccttgtacggtgtcattagcgatgtcatatatggcatcctcattagcgatgtcgtatacggagtcctcattagcgatgccgtgcacggcatcctcgttagcaatgccgtgggcagcatcctcgttggcgatgccgtgggcggcgtcctccttggcgatgccctgggcggcgtcctcgttggcgatgccctgggcggcgacctcgttggcgatgccctgggcggcgtcctcgctggcgattccgtgggcggcgtcctcgttggcgatgccctgggcggcgtcctcgttggcgatgcccttgtcggcggcctcgttagcgatgccgtggacagcgtcctcgttagtgatatcgtgtgaggcatcctcgttagtgatgttgtgtacggtgtcctcatggggagctagaagaacacagagttaaggtcagtgccctggtagtggagactgtgaatcacccaggggcttgcttggtgtggtgcatggaggtggctgatcacagcatgggccaagctgatgctgggacatcctcccaggtggacctgcactagtgaagctaagggatgtggctcagaacactttctgcagtgggcatcagtttccaggttcaggtatgcattatccagtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgcgaaatctaacttagctgccaacataaagattctatctcatttacttggtctcgagaaaatctagcacatagtaagtagaccaaaatgttcattaaatgaaaacacagagcagagataggggggctgctaggcagactgggttgcacctgattacctggatgataattaactgcacaaaacctcggtcaaattaatattgaaactgccttttgcttgggctcgtttcccttgcggaagaaggatgaccaaggagatgaacaggaaagaaatgagaaacagaggcctttgcctagtagctaaaggccaccttctataacacgaaatagccttgaactctgccgtgatttagtgacagagttccctcgtgtcttctacccaggttgaagtccagcaaaattgcgactgtcctctttacaacttgcgagaccacactgcttctgcatttgcctgttgtatgtatgagatttacacttgttttaaagcaacattttgtttcagttgggctggtggccatacccggcactagccagtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaaaaaaaggatcggtgagctgagccaaacacctggggatctttgtgcttttgacacactgatgactatgcctgtccgtggggagatgaacccataactgccctgggttgtgtgaccacggaggccactttatgatgatgggcagtgtctggggccttttgggctcggtgccttagggtttatacatgaatgctggactccctgtgtggtggtgaacaccccatgactaagtgcatgtcagcgtcagcactggcccacactcctgggttcgtgttttcactttttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataaatgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggtaagtgattccagaatacttactagattcacgcctcagaggggccacctgcaccacctgcaatacagaaacaaagctttttgaggggtatgtcatgttgtggattgtttgcacaaggctgtgtttctctcaatgaatattgaaaacttgatcagaaagtgtagtcaacttcaaggcctccaaaacaagggtaggatacacactggaaaagacatcagcttctggatggcggatctctcaggtccacgtaggttggcaagtgcaaaatactgaatccaaggagaagacattgcttccaaggacaaggaccccaaggatacagtctacaacctgaagccatcatagctaaatgccattttggattacatatcagttgctaagagtcacttcttcctccccctcagaaaactgcatttaatacctgtcatggacattgtcatcttttcacatgtaaagtcagttgaaaaagaaagacaacaagaaaggaacatttctatttcagagaaagcaaggcaaccttaccttcacgttgactggcctctctccatctcctctgtccttgtgaactagagactcctcagaggctaggaggacacagagcaacagttagtcatagatgcttttgttcatgagctattcagggagctctgcttaatgtggacaacaggacagtgtgtgtggatgtgtttcattaaaagcacagcttgagctcctgctagaaaatcctccctcgtggaaagacaggcaagaacgaggagctaaggagcaagaaatagagtccctggcattttgctgatggcaacttaaggcaatgggaatgagtcagtctacaaatggtactgaagcacatgctatagtttgatgagagtcccactgctcacactgtgaggtttgaaacccagctaaatggttttctaaacctgtaaaaacaatattacttgcaggatttatgtcccaagactacttttacctctgaggatccacagtggctgtcactgcagttattatgtgttttagcattttgcacttgaataaaagcaaagtttaatagacagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagacaggagacatgggttgaatgctggtatgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaatgaagtttgtgaatctaaagttctacacaaagggggaaatatttgcaaatcatttatcttgtaagagactaaaatttagaatatttttaaatatatttaagatatattcaaaaatctacagcaacaaactaactaaataaaaatcagacaactctttaaaaatgggcaaaagacttcaacatatatttccctaaagaagatatagccacaaatagtagcacaggaaaagctgctcaggatcattagtcattagggaaatgcaaatgaaaaacacaagcagccaccaatatacacctactaggatgatttaaaggaaaataagtgtgaacaaggatgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggcgctatattgcttattgtggacaaggttttgtaagaaatcatcaaaattgtgggtgtagatagtggtgttggttatgcaaccctgtgaatatattgaatgccacggagtgcacactttggttaaaaggttcaaatgataaataatgtgttatatatatttccccacgatagaaaacatgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgcattgctgacccatctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggcatgaatctaccccaaatgtccctttctggaggaagccaccattatgctgtacctccaagcataatgatacgtccacacacaccaaggcacctcactcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcattgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaacgataatctcatttgtcttatactaatctttatgtgttactttcatcatttcttacatattggggcctaccatacattgtacggtgaaattagtgctatgcatcatggtaggaatataaattggcaaaagtaatttagaaaatagttcccttctttcttaaaaaaattaggctgggtgtggtggctcatgcctataatcccagcactttgggaggcagaggtgggtggatcacctgaggctaggagtttgagactagcctgaccaacacagcaaaatcctgtctctactgaaaatacaaaaattatccaggtgtggtggtgtgtgccagttgtcccagctactcgggaggttgaggcacgagaattgcttaaacctgggagatggaggttccagtgagccgagattgtgccactgcactccagcctgggtctcagaaaaaaaaaaattttttttgaccaaaatgtcattatgcattacatgactgtatatgaatgctcaaagctacattactcatcaaagaaaataacaaaacaattaaatgtccattaactgataaatgaataaacactatctgtatgaataaacacagcagactatgaaggaaaacacatgaccagcacgtgctaacacgtcaattaacttcaaacatagtatgctaaatgagggaagtcagattccaaatatatatatatgtccatttctataaagcaagtgggaaatttatggagatggaatgtcacagcagtattgcttagggctggagatgggagtggggattaactgccagtgcgcaagagagaacttgggtgagggaaacatatttaaattagatcgtggtgttgggtgcacacagtatcaatttaataaagcatcaaattctagaccttttcagtgggcaaactttatggtgggttcacacccaatataggtgttaaaaataatgttacggaaattcttgtcgggtttttaacaagccaagagatatgctgtgaaagcagcattaattcaagtggttgtcacaggtcacttaaagttaatcagatagttgtcctacaaatatagggtgaatgttattcatgaatttcctgaatctattgcaataatcacatttttttccattaaactcttgaggtagctaattttatttattgcattttcaatgttaatctactatttcatatgttgagattaactcacattagtcagaatttaaagtattttaaaatatcacagaatttaatttaccttatctggttttggtttcaagactatagtagccatttcatttaattgtacatgtagggtattctaatttatggaaaactattacattttccttgatttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagccttctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaagcattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatcctttttttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccacagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcacaccttctgacaccgcaaaatgattgtcaaaaatgggtctgcaaagagtaacttcccttccactgatcaaacctgaatatgcaagctactgtcaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaacctcaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaagggaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgaggaaacattttgactcttcactatgcagcaagtgaaccagagcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctgggggaaacacagatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccggacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagactctgccatattctcccctggggaataacttaatctgtggggtggggaatggaacgttgaaggatgcaggatgtaaaaggaaattatatatatattatatatattatatattatatgatatatataatatatatattatttattatatatattatatgttatatataatatatataaataatatataatgtacataatatataattatataatatatattatatattatatattatatacataatatataattatataatgtataatatatattatatataatataatatatattatctataatatatataatatattatatatattatatattatatttaatatattatatatattatatatataatatattatatataatatatataatatattatatataatatattaaatacattatatatatattttatatatatatatattttttatatatatatatataatatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattataggcctgagtcaagatacatattttttaaatgaagaaaaatttgaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacaggtagtggcacttacgaccaagggcaggagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttgtgagatgggaagtagggcacccacaaatatatatatatataattatatataatataatatatagtatatatataatatatttaatatattatatatatatataatttgggaatttgggaataaactgaatcccaattcacactgggactacaccagctgccaccatgcctggctaattgtttgtatttgtagtagagacagggtttcactgtattggccaggatggtcttgatctcctctccttgtgatcctcttgccttggcctcccaaagtgctgggattacaggcctgagtcaagatacatattttttaaatgaagaaaaatttcaaagttactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcagaatcagggaaaatgaaaccacaatggttcaatctgctctgacctttgaaaaactcagcacagatactggcacttaggagcaagggcaggagatccctaatcccatcaccatggcgatagggcataaacattccagggtgaaggcacaatccacactgtgaggtccaactgctgccgtgcagacaggagggcttttacaagtacaggaaggtcatcaaaggctcagtgttttctttcaaaaactgaatcccaagcccacacattattatgctggcttcttaaaataagttatgagatgggaaatagggcacccacaaatatatatatatataattatatacaatataatatatataatatatataacatatatataatttccttttacatcctgcatccttatattatatataatattatgtataatataatatgtattattatatataatataatatatatgaatatatataattatataatataatatgtaattctatataattctatataatataatatatattatatataaatatatataatatactatattatatataagtatacataatatattatatatacgtatacataatatagtatattatataaacatatatataatatattatatatacgtatatataatatattatatatacgtatatataatatattatattatatatacgtatatataatattatatatacgtatatataatatattatattatatatacgtatatataatattatatatatattatatataagtatatataataatgtaatatattatatataagtgtatataatgtaatatataatataatataataatatattataatatattatatattataacataatataatataatatacattataatataatatataatattatatataatataatatataatataaaataatataatatataatataatatataaaataataattaatattttaaattaattattattaattaatattaattaatattaaaaataatataaaatataattactataatataatctataattattatatataatataatatacaattatatataatattatatataataaaatatatataattatgtgtatttattacatataatataatacataaattatatataattattacatataatataatatataattatatataattattacatataatataatatataattagatataattattacatatgatataatatataattatatataattattacatatgatataatatatataattatatataattatataattatatatacaagataataatatataatatataatatatattacataatattttatataatatattatactatatatattatataatattttatataaaatattatatattatatataatataatattttatataaaatattatatattatatataatataatattttatacaatataatatataatatatattatattatcatatgttatacaataatatgttatagtataatatatattataatctaatatattatatattattatatattatattatatataacattatatagtattatatattttataataataatataatatataatattatatattatatataatatataatatattatgacatattatatataatatataatatattatgaatatattatatataatatataatatattgtgatatatattatatattatataatatattatgatatatattatatataatataatataattatatgtaatataatattatatatcttatatatcacatattatatattttatatcatatactatatattatatcatacattacatataatgtatgtcacatattatatgtaatatatgtcacatatatgtaatatatgtcatatattatatataatatatatcatatattatatatgtcatttattctgtaatatgtatcatacatattacataatatgtattatggtgtctggtggtcccaggacacagactgatgtcactcagcctcacatgacactctgtcctcaccacacttggggtcctgggagtcgtagcaccaggcacctatagagacagtgggcaggaggctgagctgagagaccagtcatctgggtcctctccaagccccatcccatcaactggggtccaagaatgaagtaggccaggggcttaggccaggggaggccagtgaagaaccttctctcatgtcacccctaccccagtattttctctccccagtccctccccactcccagtggcaagacctaaggggtggtggagcatggcaagagggtagattggagaccagacgggaagagtcctggtgctcactctcagagtctgcaccacaccagctgcaccgcaaggcgagcatgatgccaggggcgtgcgtggctcagtggcagccgcagctaggaaggactagaaagtggctagaccgcggagccaagatgctggcctggctactacatatttattcattagctagctgggctaggggcgtggctattgaggagaggatgggaggggtcggtgcccaggcagggccaccaggaagagcgggagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgcccatgactttcggggcaaggatgggaggaaggtgtaggatgtctcttgccccgctgtgggcctggaactgccaccccatcccaagaccatagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctggaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtctcgaatgcctgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtccgtggtcacacagctcagggcaggtatttattagtacatgaatagcttagctgtgtcatagtctttatgtgaaaggcacaaaaaaaggcactttggcaggctgaaagtgtggggattataggtgtcagccaccgtgcctagcccactggatgacttatgatatcatatgtgacattgtgacatcatgtgagtcagggatgtaccccgttctcagctgctatatgctatgttacactgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcacctgaggcaggagaattgcttgaacccaggaggcagaggttgcagtgagctgagattgcaccactgcactccagccttggggacagagtgagactgtatctcaaaaaaataaaataaaataatctaggacaaccaagagaaggactcaggctcaccttactccatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgcaggcctgattcacagtgtatgtgagtcacaaatgtcacttatgacaccatacagcaggtgagaggggatagtcattactcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggagatgcagacacaaatcacactgtgtgctgtatcccatatatgtgtttaatttctgtgtttaagagagctgggttcatgaatgaacttagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgctcactgatacatatttgctccgtactgaagtgaggcagatgcatgagtgattgagaataatgctgccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagtatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccgatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccgggcacagtggctcatgtctgtaatcccagcactttcgggagccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaattggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggccggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccctaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagacgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagaatttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaatgtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggtggaggttgcagtgagccgagacagcaccattgcactccagccttagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaacatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatttatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaacgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttcctgttttttttttttttttaattatactttaagttctggggtagccgtgcagaaagtgcaggtttattacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctcattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagcgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcactttaaataatgtacaaaatctacaaaaatcatatttaccaggacacatctgttaaataaaagcattgtttcgtgttggtatacatatatacaagactatgtataacagactgtttcccctccctgcaaccacagaaccatcacacacaggcacagatacacgtcagctatgccgctttccacgaatgcatggaacccaggacgcgaacccacagctcgaggtcttataccttcactactgagctgccgccactgcagcagcaacacctctgcggaggtgttgctgaaatcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacaaggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacacttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagccgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccaccctagcggcgccctcccatcccggggcctcgctggctgtgccctggatggaaaggtcccgcccctcatggccgggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgtgtgttttctgcacctggtacagctggatggcctcctcaatgccgtcgtcgctgctggagtcggacgcctcgggagcctgtacggcgctcgtgactcgctttcccctccttgcggtgctggcgctccttttaatcccacttttattctgtactgcttctgaagggcggtgggggttgctggctttgtgctgccctccttctcctgcgtggtcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttgggtctcatgctgtcttttctcattcagaaactgttctatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttcccgcttacatctactgcctccgcccgcagccctggaaggctgtgcatggctgggccccgctggccccgggctgtgccgctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggcgggacagaggcctcccatttgggctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcactgcaagctctgcctcccgggttcaagtcattctcctgcctccgcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttacttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggcttactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcgtccgccacggcacccagcttgcattttcattttattcattgtattcttcagttctagaatttctgtttggttcttattatttctgtatctttattgaacttttagctttgctcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttctttttttttttttttttttttttttttgagacagagtcttgctctgtcacccagctggagtgcagtggtgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatattacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgagttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggtatgtaaaggcatcactgaattcctgggcaggcatgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactggtaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacatctgtaatcccagagtaatttgggaggctgaggcgggtggattgcttgaagccaggagcttgacatcagcctggccaacatggtgaaaccccatctctactaaaaatacaaaaattagctgggcgtggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagatttaaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaatttcagccaggccaacatggtgaaaccctgtctctactaaaaacacaaaaattagctgggagtggtggtacgtgcctgtagtcccagctacccaggaggctgaggcatgaaaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgcctgtctatgttttagagacaaggtctagctctattgccctggcaacaatcagatgcaaccagaatcagtggcacaatcggctcactgcagccttgaattcctgggctcgccactatgccagctcttttttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactcttgtctctactaaaaatacaaaattagccatgtgtggtggtgcatgcctgtaacctcagctactcgggaggctgagacaagagaatcgcttcaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcttggagaaggtttaccctgtggaatttctagtgtgtatgtgtatgtgtgtgggtatatatatatacacatatgtatatattttcaactttactatatatttccaaaaaactcttcaaagtggcagatttaaactccccttcgccgtgtataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtgtagtagttcttaatcattttttctactatattatttattttatatcatgaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttatatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcagaataactttggttcttcctttccattgattattttaatatgacttttccaatcaagttctaaaaaaatactggtggtatatttattgaaataactttaataaaattaaatgaaagatcatgtgttttctgaattaattcttagatacgttaatgttttatgttaccatgaatgtgatattataatataatatttttaattggttgctactgtttataagaatttcattttctctttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctataatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttattttttttcctacatctgctaaggtaatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctagtatatttaaactattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttgttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggattcggcccggtgtggtggctcacgcctgtaatcccaatactttgggaggccaaggtgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcaaaaaaaaaaaaaaaaaaaaaaagagtgcaatggaaagctggtagaaaatggacattgtttaaagaccaaaacaaccacactactttgctaatccctatcagctaaagcctagagaatatatgaggtatagatttacatggtgtttgactaaggcatgcagaatataatcttgacataggctaagtttatcaacatagatacatagagattctgaagttaaagtcttagcccaagaagttagaaggggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctctaagaaattaaggattcgtttgttggggagggctgctggcatgcttgaaaagtactgtgatggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattctgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgaacattactgcctgagctccgcctcctgtcagatcagcagcagcattagaccttcacaggagcacaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaagaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggcgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaaaatatatatatattacaaaatttaaagagagtggtacaccagtaaaggacatttagcatgaacagaggttgcaggactggcagatgctctgatgagtcagtgagtacctggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagtcctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgtttcatagttaattttttttaatgagtagtagtactacactctaaaatatgaataaaatctgtagtattatacatactgttgatccttgaacagtgcaagggttaggggaccagctcctgtgcagttgaaaatccatatataattctgggctatccccaaacttaacttaatatgatatatatcatatataatatatatgatatatatcgtatatattacatatgatatatatcatatataatatatacgatatatatcatacataatatgtatgatatatattatacacaatatgtatgatatatattacatacaataagtatgatatatattatatacaatatgtatgatatatattatatacaatatatgatatatattatatactatatgatatagattatatacaatatatatgatagagattatatacaatatatatgatacagattaaatacaatatatatgatacagattatatacaatatatatgatacagattatatacaacatatatgatagattatatacaatatatatgatatagattatatacaatatatatgatatagattatatacaatatatatgatatagattatatacaatatatatgatatagattatatactacatatgatatacatgatatatcatatatatgatatacatggtatatcatatatgatatatacgatatatcgcatatatgatatagatgatatatcgtatatatgacatagatgatatatcatacctgatatagatgataaataatatatgatatagatgatatatatcatatatgatatatcatatattatataataaatgatatatattatatataataaaagatatatattacataataaatgatatatattatgtaaaatatatgatatatattatatattatatctgatatatattatatattatatattttatctgatatatattatatattatatctgatatattatatataattatattatattatattatatattatatattttatattatatgatatataattatattatattatattatattatatatattatattatatataattatattatattatatattatatattatattatatataattatattatatgatattatatattatatataatttatgatatatattatgtattatatataatttatgatatatataatatattatttatcatatatcatatatattatggtatattatatataattgtattatatataataatatataatataccataatatatcatatattatataatatataatataatataatataatgtaatcatatataatatataatatattatattataaaatatattatattatgatatactatatattacatgttacattatataatattttgtataatatataatatatattatctattatactttattatattacatatataattatacattattatatttcatatataattatataattatacataattatatatattatattatatataatgttatgtataacaatatatattatacataatattatatattatattaaatatgatattatatataaggatgcaggatgtaaaaggaaattatatatatgttatatattatatatattatattatacataatatatatatatatttgggggtgccctatttcctatctcataacttattttaagaagcacagcataataatgtgtggacttgggattcagtttttgaaatgaaacactgagccttcgatgaccttcctgtacatgtgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattattgtaccaagcagagtacctttgaaatttttcttcatttaaaaaatatgtatcttggctcaagcctgtaatcccagcactttgggaggccaaggcaagaggatcacaaggtgaggagatgaagaccatcctggccaatgtggcgaaaccctatctctactaaaaatacaaaaaattagccaggcatggtggcagctggtgtagtcccagtgtggtgtagccccagctacctgggaggctgaagcaggacaatcgcttccacccgtgaggcagaggttgcagtgagccaagatggcaccattgcattccagcctgtgcaacagaacaagaatctgtctaaaaaaaattatatatatataatgtatattatatgtactatatattacataaaacatataatatataatatatataatatatataaaatataatatacattatatataaataatatatattatatgtcacgttatgtaatatctatgatacatattacataataaaagacatatataatatatgatatatattacatataatatatgatatatattacatataatatatgatatatattacatataatatatgatatatattacatataatatatgatatatattacatataatatgtgacatatattacatacaatatgtgacatatattatatgtaatatatgatatataatatataatatatggtatataatatataatatatgatatataatatatgatatataatatataatatatgatatataatgttatattacatataattatattatattatattatatatatcataatatattatataatatataatatatatcataatatattatataatatataatatatatcataatatattatgtaatatatataatatatcattttatatattatatataatatgtcataatatattatataatattatatataatatatcataatatattatatattatattattataaaatatataatactatataatgttatatataatataatattatattagattataatatataatattatattagattataatatataatattagattataatatataatatattagattataatatacattatattataatatattattgtataatatgttataatataatatatattatatattatattatacataatattatattatatataatatatataatattttatacaacatattatatataatatcttatataatatattatacaatatattatattgtataatatattatatatattatgtattattatcttgtatatataattatatataattatataattatatatattatattataggtaataattatatataattatatattatattatatgtaataattatatataagtatatattatattatatgtaataattatatataatttatgtattatattatatgtaataaatacacataattatatatattttattatatatattatgtataattgtatattatattatatataataattataggttatattagatatattaattgtattttatattatttttaatattagttaatattaattaataataattaatttaaatattaattattattttatatattatattatatattatgttatatattatattatatattatattatattatatattatattatattatatattatattatatattatattatatataatatagataattatatattatatatcattatatataattacatatattatattatattgctatatatattcatatatattatattatatataataatacctattatattatacataatattatatataatataaggatgcaggatgtaaaaggaaattatatatatgttatatatattatatatattatgtcatatataattatatatatatatttttttgggtgccctatttcccatctcataacttattttaagaagccagcataataatgtgtgggcttgggattcagtttttgaaacaaaacactgagcctttgatgaccttcctgtagttgtaaaagccctcacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaacgtcagagcagattgaaccattgtggtttcattttccctgattttgatttttcttatggggaacctgtgtggctgcattcaaggtatgttcttactggcctgtcaaatgcgatcttttcaaattactagttaatactttcaaaatatattatttaaaaaattagcctctgtattttccatatgcagttataaatatgtttcatgattatgttttattcctcaatttatatatttgattattgtaccaagcagagtatctttgaaatttttcttcatttaaaaaatatgtgtcttgactcaggcctgtaatcccagcactttgggagcccaaggcaagaggatcacaaggtgaggagatcaagaccatcctggccaatacagtgaaaccctgtctctactacaaatagaaaaaattagccaggcatggtggcagctggtgtagtcccagtgtgaattgggattcagtttattcccaaattcccaaattttatatatatatatatataaaatatattaaatatattatatatatactatatattatattatatataattatatatatatatatttttgggtgccctatttcccatctcataacttattttaagaagccagcataataatgtgtgggcttgggattcagtttttgaaacaaaacactgagcctttgatgaccttcctgtagttgtaaaagcccacctgtctgcatggcagcagttggacctcacagtgtggattgtgccttcaccctggaatgtttatgccctatcaccatggtgatgggattagggatctcctgcccttggtcctacgtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattactgtaccaagcagagtatctttgaaatttttcttcatttaaaaaatatgtatcttgactcaggcctgtaatcccagcactttgggaggccaaggcaagaggatcacaaggtgaggagatcaagaccatcctggcgaatacagtgaaaccctgtctctactacaaatacaatcaattagccaggcatggtggcagctggtgtagtcccagtgtgaattgggagtccgtttattcccaaattcccaaattttatatatatatatatataatatatataatatataatatattatatatattttatataatatataatatatataacatatatattatatataatatatacattatatgtaatatattatatatattttatattatatataaaatatatatactatatataatatatatagtatatataatatatattatatataatatatatagtatatataatatatattatatataatatatatagtatatataatatatattatatataatatgtataatattatatattatatatattatatatattatatattatatattatgtatataatatatattatttatatattatatataatatataatatataatatataatatataattatatattatatatattatatattatataatatataataaataatatatattatatatataatatatatgatatataattatatattatatattatataatatataatatataataaataattatatatcatatatataatatatataatatatataaataatatatattatatacataatataattatcatatattatatatatgtcatatataatatatgtcataatataatatatgtcataatatatataatataatatatgtcataatatatatataatttccttttacatcctgcatccttcaacctgcatccttcaacgttccatcccccaccccacagattaagttattcccctggggagaatatggcgaagtctattttaatgctgtttttaacccaattaagaacctatgaaatcattactttccaaaactttggaacaaagccacagtagtaaggatccgttggaggcttttcacacaataaaatgtaactctctttgtttttaacatgtttttcccttcctctcttctttttttgtgaaatgtgtatttactttaatatatttgtagtaagtcacttccatgcacatattaattttttaaagtaataagcatgtgtattgtctacgtgtgaaagaaaacacacatttatttttatgctttggaagttatccagaatcatggaattgtcaatcacagtcaatcacccaacctactcacctttccagtgtaatcttagtcaaatttttttttttgttatccaatgagatgcagtatttcaactcagaaagataaatagagtgaatttatagagactattaactaagaacatacagtttgatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcatccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacagggcagaaccctataccctccatgataaatgcagtagcagtgtatgtgggtctgtggaggttgaaagggacttggtcgatgtcaagaaggtagtggcagtcctgctgggcttttaaagggtctgaagaagtgacaggatgctgtggttgaatcgtagcatgtgttttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctaccaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaacaaaagctcctgtgctttcctaaggcaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttcctcatacggtgctaatgttgaaggcctgaactacaaccactatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagactggtcattttaggtcaaattttacccagagctggtgcagccactgcccattcttagccagaccttattgcaggcagctctgatcaatagtcaaggaggcagtgggggttgcagacttaattcattaaatcaccaaagcaccagcccacacggccacttttccagttaattcacagtagcttgcatattcaggtttgatcagtggaagggaagttactctttgcagacccatcttttgacaatcattttgcagtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaaaacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagtcacagcccctcctctgcaccccctgcagggctgatgttctccataaaccataaggcatcatgcccacggaaaagccgaacaggaaagcatgctccactgccccggagccatccaagttccccctccatattccgccactgctgagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaggacatgagcttgccaggtccacatggcttagtggaatttgaatccgggcccctactctgcaccagccctgcactcacagtcatcctgctgtattctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcctctgtcagcaagatgtcaacagccctatctattgtaaatgcattaaccagcatcttctctgatagagaatataagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgtgtgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccgggaggcagaggttgcagtgagccaagatcatgccattgcactccagcctgggtgacaagagtgaaactccatctcaaaataaataaataaataaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctgcatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtcaaaaaaatttttttttttctgagacccaggctggagtgcagtggcacaatctcggctcactggaacctccacctcccaggtttaagcaattctcgtgcctcaacctcccgagtagctgggacaactggcacacgccaccatgcctggataatttttgtattttcaggagagacaggattttgctgtgttggtcaggctagtctcaaactcctagcctcaggtgatccacccatctctgcctcccaaagtgctgggattataggcatgagccaccacacccagcctaatttttttaagaaagaagggaactattttctaaattacttttgccaatttatatttctaccatgatgcatagcactaatttcaccgtacaatgtatggtaggccccaatatgtaagaaatgatgaaagtaacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaaaaacacttgtactaacaacgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagcgaggtgccttggtgtgtgtggacgtaccattatgcttggaggtacagcataatggtggcttcctccagaaagggacatttggggtggattcattccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagacaggacagcaaagcatgggagacagagttcttggccctgcagggtgagtactgtggattctcaaattttctcctctctccattaatttctttcccaatgcagatgacttccatcatacagtcttcagcaatcttgaaagattggacaagcttcagcccactcttgaaggtaaaggaaggcagctaacaagactggcatctgggcttggctgtgcgtgttttctatcgtggggaaatatatataacacaatatttatcatttgaaccttttaaccaaagtgtgcactccatggcattcaatatattcacagggttgcataaccagcaccactatctacacccacaattttgatgatttcttacgaaaccttgtccacaataagcaatatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtagcatctatcaaaatgatgttcgttttttacagatggatgatgtagcattgcatgcagaccactttgcttttattacattcatttgttcactgatggttggattatttccaccttttggctcctgtgaaaagtgatgctacaaacattagtatacaaacatctgtttgatttccgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagataaatgatttgcaaatatttccacctttgtgtagaactttagattcacaaacttcattaatttgtatgaaatcctcggcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgtttagttcaccacacttgttgcaactgtttgcgctgcagagttaaaacacaccagcattcaacccatgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaagatataatttcagtacttctaattctcccatcagcagttataacaaaggattagtgaataaataccatagactgttttgcctagaatcgaatccaatctgtctattaaactttgcttttattcaagtgcaaaatgctaaaacacataataactgcagtgacagccactgtggatcctcagaggtaaaagtagtcttgggacataaatcctgcaagctaatatcgtttttacagggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccaccagggaagattttctagcaggagctcaagctgtgcttttaatgaaacacatccacacacactgtcctgttgtccacattgagcagagctccctgaataactcatgaacaaaagcatctatgactaactgttgctctgtgtcctcttagcctctgaggagtctctagttcacaaggacagaggagatggagagaggccagtcaacgtgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtggactgtatccttggggtccttgtccttggaagcaatgtcttctccttggattcagtattttgcacttgccaacctacgtggacctgagagatacaccgtccagaagctgatgccttttccagtgtgtatcctacccttgttttggaggccttgaagttgactacactttctgatcaagttttcaatattcattgagagaaacacagccttgtgcaaacaatccacaacgtgacatacccctcaaaaagctttgtttctgtattgcaggtggtgcaggtggcccctctgaggcatgaatctagtaagtattctggaatcacttgccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaaactgaagggccaagggagtggccccagctcccgagttcctgaatgaaaaagtgaaaacacgaacccaggagtgtgggccagtgctgacgctgacatggcacttagtcatggggtgttcaccaccacacagggagtccaacattcatgtataagccctaaagcaccgagcccaaaaggccccagacactgcccatcatcataaagtgggctccgtggtcacacaacccaaggcagttataggctcatctccccacagacaggcatagtcatcagtgtgtcaaaagcacaaagatccccaggtgtttggctcagctcaccaatccttttttttttttttttttaacttttaagttcaggggtacatgggcaggatgtgcaggtttgctacatatataaatgtgtgtcatgagagtttgttgtacagattattgcatcacccatatattgagcctaatatcagttatttttcctgatcctccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactgaatcacggcagagttcaaggccacttgcagactatttcatgttatagaaggtggcctttagctactaagcaaaggcctctgtttctcatttctttcctgttcatcttcttcgtcatccttcttccgcaagggaaacgagcccaagcaaaagacagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttaacataactgacaaaaattaaaatttctgatttcttgtaaaaatattttgtatgtgtgaatgcatactgaatgtaaagtggataaaaaaaatcacacttgcactcatggaaggcttttcatgaatttgtcaatttctatttttttatatttccccatttcaccggataatacatacctgaacctggaaaatgattcccacagcagaaagtgttctgagccacatcccttagcttcactagtgcaggtccacctgggagtatgtcccaccatcagcttgacccatgctgtaatcagccacctccatgcatcacaccaagcaagcccctgggtgattcacagtctccagcaccagggcactgaccttaactctgtgttcttctagctccctatgaggacactgtacacgacatcgctaatgaggacgctgtatatgacattgctactgaggacgccatatatgacatcgctaacgaggacgccgtccagggcatcgcaaaggaggacgccgcccagggcatcgctaacgaggaagccgtccacgacatcgctaacgaggatgccgcccacgtaatcgctaacgaggacgccgcccagagcatcgctaacgaggacgcggtccacgacatcgctaacgaggatgccacccagggcatcgttaatgaggacgccgcccacaatatcgctaatgaggacgccgcccacggcgtcgctaacgaggtcgccgcccagggcgtcgctaacgaggacgccgtccactgcatcgctaacgaggtcgccgcccagggcgtccttaaagaggacgccgcccaggacatcgcaaacgaggacgccgcccagggcatcgctaacgaggacgccgcccacggcatcgcaaacgaggacgcagcccaggacatcgcaaacgaggacgccgcccaggacatcgcaaacgaggacgccgcccagggcatctctaaggaggacgccgtccagggcatcgcgaacgaggatgccgcccagggcatcgctaaggaggaccccgtccagggcgtcgctaacgaggaccccgtccagggcgtcaataacgaggacgccgtccagggcatcgctaaggaggaccccgtccagggcgtcgctaacgaggaccccgtccagggcgtcgctaacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggttgccgcccagggcatcgctaccgaggacgtcgccgacggcatcgctaacgaggacgccgcccacggcgtcgctaacgaggtcgccgcccagggcgtcgctaacgaggacgccgtcgagggcgtcgctaacgaggacgccgcccagggcgtcgctaaagaggtcaccgcccacggcgtcgctaacgaggacgccgtccagggtgtcgttaacgaggacgccctccacggcgtcgtcgctaacgaggatgccgcccaagcgatcgctaagccggacgccgcccatggcatcgctaacgaggtcaccgcgcagggcatcgctaacgaggtcgccatccacagcatcgctatcgaggacaccacaccgtccagggcgtggctaacgaggtcgctgcccagggcatcgctaccgaggatgtcgccgacggcatcgctgaggacgccgcccatggcatcactaacaaggaggccgcccaggccatcgctaagcaggatgccgcccacggcatcactaacgaggacgccgtccagggcgtcgctaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgcccagggcgtcgctaacgaggacgccgtccagggcgtcgctaacgaggtcgaagtccagggcatcgcacacaaggacgccatccagggcatcgctaacgaggatgccgcccacggcatcgctaacgaggtcgccgcccacggcatcgcaaacgaggacgctgcccagggcatcgcgaacgaggacgccgcccagggcatcgctaacgaggtcgccgcccacggcatctctaaggaggacaccgtccagggcatcgcgaacgaggacgccgcccagggcatcgctaaagagaaccccgtccagggcgtcgctaacgaggaccctgtccagggcgtcgctaacgaggttgaagtccagggcgtcgcacacgaggacgccgtccagggcatcgctaacgaggacgccgcccacggcatcgcgaacgaggtcgctgcccagggcatcgcgaacgaggacgccgcccaggacatcgcaaaggaggatgccgcccaggacatcgcaaacgaggacgccgcccagggcatctctaaggaggacgccgtccagggcatcgcgaacgaggacgccgcccagggcatcgctaaggaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatagcacatgaggatgccgtccagggcatcgctaacgaggacgccgtccacggcgtcgctaaagaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaatgaggacgccgcccacggcgtcgctaaagaggtcaccgcccacggcgtcgctaacgaggacgccgtccagggcgtcgttaacgaggacgccctccacggcgtcgtcgctaacgaggatgccgcccaagcgatcgctaagccggacgccgcccatggcatcgctaacgaggtcgccgcccacggcatcgcgaacgaggacgccgcccagggcatcgctaacgaggtcgccgcccacggcatctctaaggaggacgctgtccagggcatcgcgaacgaggacgccgcccagggcatcgcgaacgaggacgccgcccagggcatcgcacacgaggacgccgtccagggcatcgctaacgaggacgccgtccacggcgtcgctaaagaggtcgccgcccacggcgtcgctaacaaggatgccgcccacgcgatcgctaagccggacgccgcccgcggcatcgctaacgaggttgccgcccagggcatcgctaccgaggatgtcgccgacggcatcgctaacaaggacgccgtccacggcgtcgctaacgaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaacgaggacgccgcccacggcgtcgctaacgaggtcgccgcccacggcgtcgctatcgaggacgccgtccagggcgtcgctaacgaggacgccgtccacggcgtcgctaacgaggacgccgcccagggcgtcgctaaagaggtcaccgcccacggcgtcgctaacgaggacgccgtccagggcgtcgttaatgaggacgccctccacagcgtcttcgctaacgaggatgccgcccaagcgatcgctaagccggacgccgcccatggcatcgctaacgaggtcgccgcccacggcatcgggaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccctgtccagggcgtcgctaacgaggacgtcgtccagggcgtcgctaacgaggttgaagtccagggcatcgcacacgaggacgccgtccagggcatcgctaacgaggacgccgcccacggcatcgctaacgaggtcgccgcccacggcgtcgcgaacgaggacgccgcccagggcgtcgctaacgaggacgccgcccagggcgtcgctaacgaggacgccgtccacggcgtcgctaacgaggacgccgcccagggcgtcgctaaagaggtcaccgcccacggcgtcactaacgaggacgccgtccagggcgtcgttaaccaggaggccctccatggcgtcgtcgctaacgaggatgccgcccaagcgatcgctaagccggacagcgcccatggcatcgctaacgaggtcgccgcccagggcatcgctaacgaggtcgccgtccacagcatcgctatcgaggacaccacaccgtccagggcgtggctaacgaggtcgctgcccagggcatcgctaccgaggatgtcgccgacggcatcgctgaggacgccgcccatggcatcactaacgaggaggccgcccaggccatcgctaagcaggatgccgcccacagcatcactaacgaggatgccgtccagggcgtcgctaacgaggacgccgcccacggcgtcgctaacgaggacgccgcccagggcatcgctaacgaggtcgccacccatggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggttgccgcccacggcgtcgctaacgaggaccccgtccagggcgtcgctaacgaggacgccgtccagggcgtcgctaacgaggttgaagtccagggtgtcgcacacgaggacgccgtccagggcatcgctaacgaggacgccgcccacggcatcgctaacgaggtcgctgcccatggcatcgcgaacgaggatgccgcccagggcatcgcgaacgaggacgccgcccagggcatcgcacacgaggacgccgtccagggcatcgctaacgaggacgccgtccacggcatcgctaaagaggtcgccgcccacggcgtcgctaacgaggatgccgcccacgcgatcgctaagccggacgccgcccgcggcatcgctaacgaggtcgccacccagggcatcgctacccaggatgtcgccgacggcatcgctaacgaggacgccgcccacggcgtcgctaacgaggtcgccgcccacggcatcgctaacgaggtcgccgtccactgcgtcgctatcgaggacgccgcccagggcgtcgctaaagaggtcaccgcccacggcgtcgctaacgaggacgccgtccagggcgtcgttaacgagtacgccctccacagcgtcgtcgctaacgaggatgccgcccaagcaatcgctaagccggacgccgcccatggcatcgctaacgaggtcgccgcccacagcatcgcgaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatcgcgaacgaggacgccgcccagggcatcgcacacgaggacgccgtccagggcatcgctaacgaggacgccgtccacagcgtcgctaaagaggtcgccgcccatggcgtcgctaacgaggatgccgcccacgcgatcgctaagccggacgccgcccgcggcatcgctaacgaggttgccgcccagggcatcgctaccgaggatgtcgccgacggcatcgctaacgaggacgccgcccacggcgtcgctaacgaggtcgccgcccacggcatctctaaggaggacgccgtccagggcatcgcgaacgaggacgccgcccagggcatcgctaaggaggaccccatccagggcgtcgctaacgaggttgaagtccagggcgtcgcacacgaggacgccgtccagggcatcgctaacgaggacgccgcccacggcatcgccaacgaggacgctgcccagggcatcgcgaacgaggacgccgcccaggacatcgcaaacgaggacgccgcccagggcatcgctaaggaggaccccgtccagggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcgctaacgaggtcgccgcccacggcatcgcgaacgaggacgccgcccagggcatcgcgaacgaggacgccgcccagggcattgcacacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggtcgccgcccagggcatcgctaccgaggatgtcgccgacggcatcgctaacgaggacgccgcccacggcgtcgctaacgaggatgccgcccaagcgatcgctaagccggacgccgcccatggcatcgctaatgaggtcgccgcccagggcatcgctaacgaggtcgccgtccacagcatcgctatcgaggacaccacaccgtccagggcgtggctaacgaagtcgctgcccagggcattgctaccgaggatgtcgccgacggcatcgctgaggacgccgtccagggcatcactaacgaggaggccgcccaggccatcgctaagcaggacgccgcccacggcatcactaacgaggacgccgcccagggcgtcactaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgtccacggcgtcgctaacgaggacgccgtccagggcgtcgctaacgaggtcgaagtccagggcatcgcacacaaggacgccatccagggcatcgctaacgaggacgccgcccagggcgtcgctaacgaggacgccgcccagggcgtcgctaacgaggtcgccgcccacggcgtcgctaacgaggatgccgcccacggcgtcgctaacgaggtcgccgcccagggcgtcgctaacgaggacgccgcccagggcgtcgctaacgaggtcgccgtccacggcgtcgctaacgaggacgccgcccggcacatggctaaggaggacgccgcccaggacatcgctaacgaggacgccgcccacggcatcgctaacgaggacgccgtacacggcatcgctaacgaggactccgtatacggcatcgctaatgaggatgccgtatatgacatcgctaatgacaccgtacaaggcacgctaacgaggacactgtacaggacatcgctaatgaggacaccatacaaggcatcggtaatgaggacgctgtatacgacatcgctaacgaggacaccctacaagccgtcgctaacaaggacactgtacacaacatcgctaatgagggcaccatacaagacatcaccaatgagggcgctttatacgacattgctaatgataccgacaaggcacgctaacgcggacactgtacacgacatcgctaatgaggacaccgtataagacatcgctagtaactatcgcaagaacaaaaaaccaaacactgcatattctcactcataggtgggaattgaacaatgagatcacatggacacaggaaggggaatatcacactctggggactgttgtggggtgggggggggagggatagcatcgggagatatacctaatgctagatgacgagttagtgcgtgcagcacaccagcatggcacatgtatacatatgtaactagcctgcacaatgtgcacatgtaccctaaaacttaaagtataataaaaaaaaaaagacattgctagtgagcacactgtatacgacatcgctaatgaggatgctatatatgacatcgctgatgaggacgttgtacacgacatcactaatgaggacaccatacagatggcttgagcccagtagtttgagacaagcctggcaacacagcgagacctcatctctacaaacattttttaaaaatatgccaagcattgtggcgcatgcctgtagtcctggctattcaggaggctgaggtgggaggatcacctgtgcccaggagttcaaggctgcagtgagctatgatcacaccacaatgctccagcctgggcaacaaagcaagactccatctctaaaaataaaattaaattaaaaaaaaagatcttcgatgtaaaagaggtatgctcaaatgcaataaaatcatataagaaggccgggtgtggtggctcatgcctgtaatcccagcactttgggaggctgaggcaggtggatcatgaggtcaagagactgagaccatcctggccaacatcgtgaaacaccgtctctactaaaaatacaaaaaacaatcagctgggcgtggtggcacacacctgtagtcccagctattcaggaggctgaggcaggagaatcgcttgaacctgggaggcggaggttgcagtgagccaagattgtgccactgcactccagcccggcaacagagcgagactccgtcaaaaaaaagaaaaaaagaaaaccatacaagaagcccctacgaatctgggtgaatcagcaaaggcttcacaggataggaaaaggccatgagtatgaaaacatgagtggggggttggcctagatggtaaacgaggagaggacaatacggccaggaagtgcatgtgcacagcagacgggagatggagggcacggctgattggcagctacctgtactttaatattcctggagtgtgacgtgtgaggcaaacatggggtggtggggtgagtgctggagatgaggcagacagtgagccatcagcatgttagtaacaggggaatccatgggcgtttcatgcagctccaaggaccctatgtgagctcatcagactccaattacccaaatctgtttcttaccagtggtagttaggatttccgtaggtacactggatgtcttcccaggacacctggaagccagaaacaaatggggtcaagcagccagctgacacaagcacccacagaggacaggacactataatgtgcccctcatcctccagacaagcccacccctagcaactcccaagagcctggagcaacagcagcaggatgtcttgtgcagtgaagtatgtttagcgcccttgtccctgtgtttaaacttggtcatgcttttcccagaggcctaacttacatatttctaactctccttgctctctagacatttcccacaaagcaggaagctgcagagcatgagcctagagcaccaaaaacttagaagtgaagtgaattgaacccttgcagaggtgcaaaccacatggggacttcagaccgaaaaaggcttgaaccctcatcaaaggccccacacccagacagcaggatcacagtgtgtcttgatctcagagacccaggcagccctgagcccagcatttgctagaggtggccaatccagggcaggaggcaattgtggatgatgtttcttaccaagcaaatattggagtcattgaagcagaaccattttccatccacagcattccggatgtagacacagtaatgaccggagtctgccattcccacgtgcgcaatcacagcaaaaagctcatactgccctccagactggaaagagacaggcacgagacagttcacccaccaccacaaacacgactgcctcacacatttatacctgtccacccgaggcccgactctgggactttagaatattagaaaacagtcctgacccacggccagtgggcaccctccaggaggggctttcctgagtgtggatcctgaactgtgaaggctcagcagcttggcagggcagagcacacaagagatggaaggcatgaggtcatgagagaggcccccaaagccaaggcaagattagaactttcccctgggaggggtggggatcatcagaacacagttctgcttctccacaagcccaggaatgaccctaacctgagccaccgtacccagccaaaaaagtcttttgtagggggaggggagacagagggcaagggcggcacacgcaaagctgagtcacccacagtggaggctgaaattatccctatttccatttgcagactttgtgcagaactttacaaaatgcagggcaatatctgtatctaaatattagtttacaagaaataaaagggttatagatgatgttaaaagatatcaaccagccagtgctggcatatgaaaaaaatattcaaccaaatcaactgcaaggaaaagaaaaggagcggaaatctaaaaggaacttaagaaaagaaagaaacttaaccaaatgcaagtgtaggcgttgtttggatctagagtcaaacaaaccacatagattacacaacagtcaggaagtctgaacgttaaccagatatttgatgctattaaggaattgcaagatggagatgattatcttttaagtgcttattctttagtgatacataatgaagtgtttataaatgaaatagtatgatgtctgggatttgcttcaaaaaaatccagtacagggttgggtgaaacaagagggtgggttataggaaaagcaagacctgccatgcgttttggtaactgttacagccaaggattcactgtctaactcttccttcactacacactttggtatctatttgtaatgttccataacaaagtcttttttgttgttgttgcaaagatggagtcttgctttgttgtccagctgggctcgactcctggactccagcaatcctcttggccccgcaaagagctgggattacaggtgtgacccactgcatccagccaaaaaagtcttttttaagtgaaaaacaattttaaatgtacttcatcgggtagaatctgcaggtagaaataaaaagaactagaaggaaagaaaaagagaatcctatgaaatgtatacggcctaagtagggaaagaaatcatgttataataggagctattgtaacgtattatcaggtcttaattttctaaatgtcatggttctagagcataaatagccaaacagaccaataaaacagaagagacactccaaaaatagacccgtacatatagaaatacaaaatttgttatgtagcatttcaaatctatggaaaaaaagatatttgggtcctttttttttttttttttttttttttttaagtttttcttgttttgtttttagagacggggtcttgcgctgtcacccaggctggagtacaatgatagatcatagctcactgcagcctcaaactcctgggctcaagtgatcctccaactcagcctcccaagtagctgggactaaaggtttgtgctaccacacccagctaattttttttttttttttgagagacgggggtctcattatgttgctgaagctggtctcgaactcctgggctcaagcaatcctcctgcctcagccttttgaggtgtgggatcacaggcatgagccacatcacctggccttgtgtctctttttttctcagaatctcttgataagttattatctcaggacaagtgaattaaactttactctgattaaatgtggtccagtcaactggctactttatgattatcctcaaagtgggcacaggccatctgaggaagaaagtttggttggtactatgaacccacaatgacatgtttgcctatgcatttctatgtattccacattatttccaaagaagcctactgaattctggattctgtccctcagtgctgtgaggcatatgaacacaaatccaatatttagaaagaagaaaggcttttgaggctggggacagtctctgaggaacaggtggctcctagcagactgggggtgaaggaagggaaaacagaaaggacatggcatctggggagaggcaggatggcaaggaggtcgggatcatcccacctgctcctcagcatcacaagactctcgcttcattggaaggatctggctgaaatccaagctctgggggaagtacagggagtggcagatctttctcgtctgtgaattcctgatggagaatcgcatgaggtggattgtcagggtctggggcaaatgggtcagcttcaagacctgaaaaatcaaaatcactctggagatgaagtccacttggaatgagagagtcagagaaatgtcagggctagcaacgcgttcttcccaaaaagaggggagcagggcgacatcatggagttcaaggctcctgttcactgaatctgctgagctcctctgagaataatgcaaaacttggctattctaccaccatgtggccccccacaagaggcacaagggcacagggctctgcacaggtaccaggacccagggagccaccacgtctgctccagggagctggtctcgccccgagggaaatgccctgcccgctgctctcaggccccctcctgcagtccctctcagtgatgcgacatgagaagccacatccacggctccagatatcagaaccacagcgtcccagatactagccagacccagattccctttctcacccatcatgggatgtcctcggggcctctgatgattctatcaggaaatccacggggggcaaccccagactagtgaaggacagatgacccctgaacagcacaggtttggactgtatgggtccgcttatacacaaattgttgtaaataaatacagtctgccctcccccataggcacgagttccacatctgcaaccaaatgctcatcaaaaataaagtatcccagatgcacaaccgcatagatgagggactgacttttcctatacgtgggttccacagggccgactgggtgtgacttgagtgtgtgtggattttggtaaaagcaggggtcctggaacaaatcccccatatgcaccgagggacagctgagtctgatttagggaatgagtacctgtttcccacgggtcttcttcccacagttctcacagaagcatttgcttttgcttgataactccctgggctggaagaagcagtgcagggcgtcctcctgtcccacccaagagaacagggaaaaagcagcgttggtatttcccacctagaatactatattcgtctgttctcacactgctgtgagacaatagctgagactgggtaatttataagaaaagaagtttgattggcccatggttctgcaggccgaccggaagcatggcagcatctgcttctagggaggccgcaggaagctcccaatcatggcggaaggccaagcaggagcaggcgtcttacctgggaggagcaggtgcaagagaccaagtggggagctggagtgcaggagcgcgatctcagctcaccgcaacctccacctcccgggttcaagcgattctcctgcctcagcctcctaagtagctgggactacaggctgcaccaccacgcccagctaattttttatgtttttagtagagacagggttttaccatgttggccaggctggtctcaaattcctgacctcaggtgatccacccacctcagcctcccaaagtgctgggattatgggcgtgagttaccacacccagcctggctccacacttttaaacaaccagatctcatgagaactcactgtcacaaagacagtaccacgggggatggtgccaaaccattcacgagaaacactcccccatgatccaatctccttccaccaggctttacctccaacactggggattacaattgaacaggagatttttgggcagggtcacagacccaaactgtatcaggtacagcctccccacactttgcagctgagggtttcagcttttcttctggttctcctcatatcccccttaatgcctggcctggtgtggtccacttggcaggatctcaaagggcacctactgactggaggaacaaaacaggagggggctcctattaagggagcagtatgagggaagtggaggtaggagggaaaaacatttttgccaaaacaaaggagaaattggccagcgccgtgaaaatgaaataagtgactttccagaagccagagatagatcaaagaggcaagggggaattggccacactgtgctgtgtggtgtgatggtttgagggtttgtcctccccaaaacccaggttgaaactgaatccccagtgtggctgtatggaaaggtggggactttgagagataattggggagggcaaggtgtctcatgcctgtaatcccaaggaggctgaggcagggggatcacttgaagtcaggagtttcagatcagcctggccaacatggtgaaaccccatctctactaaaaatacagaaattagccgggcatggtggtgggcacctgtaatctcagctacttgggaggctgaggcaggagaatcgcttaacaccggaggcggaggttgcagtgagctgagattgtgccactgcacttcagtctgggtgacagaggaagaatctgtctccaaaataaaaggtaggggggttattgcgtcatgagggcacagccctcataaatgaattaatccactcatggattaatgggttaatcggttatcctgggagtgggactggtggcttcatatgaagaggaagagagacttgagccggcacattagcatgctcagccccctcgccatgtgatgccctgcactgcctcgcctcaggactctgagagtccccaccagcaagcaggtcctcaccaggtgcagcccctcaaccttgacttcccagcctccagaactgtaagaaataaattacctagtctcagatattgagttataacaacagaaaatggactaacacatacaggtgcagcaaataccaagagaatccccttaccagtgtcttcaggggctttgagtccacatcaaaaaaagaaagtcggagggtgagcatgctgctgtttctgctactctccatggcacagtcaaggcaaatcaaggagtccttcatccggatcatatacagggcctgcagtctctccacctgcaagagggagagcggagaggtgagatgggaacaccaccataagccaggtcaggccaactgccagaaggtggagccaagagacagaagctcctcacaaaggtgcaaaataataccagtaacaatattatgaaactgtgataagtgttttatgtggattaactcttttttttttttttttgagacagagtctcgctctgtcacccaggctggagtgcagtggcgcgatctcggctcactgcaagctccacttcccgggttcacgccattctcccacctcagcctcccgagtagctgggactacaggcgcccgccaccacgcccggctaattttttggtatttttagtagagacagggtttcaccgtgttagccaggatggtctcgatctcctgacctcgtgatctgcctgcctcagcctcccaaagtgctgggattacaggggattaactcttttattcctctacacactacgggaacaacagctgaatgaatgaaatgagcagcatcttaagcttccgagtgctctggttctaggttcttaccaagtgcacatcagcgatctggtccttaatcaggttccagagtttgaggtacagttgggcagcatcatgttggacaaacactggccacagagaaaaggaacagccaattagtgaggtcttcagagtcacttctcatgccctggtacttagacacacatgaacactgatcactttgtctcttcctagccctccaccccactgcaaggctaagtcggcacgacagaagaagtgatcaataaacaaacagtaagtttggtattgatttttgagaacgcctcttaatacttaagctccagtgccagatgtagtggctcatgcctataatcttaacacttcgggaggccaaggtgggaggatcgcttgaactcaggagtttgagaccagcctgggcaacatagcaagactccgtctcgataaaaaatttaaaaaagtacttgagagtagcggtgcacgcctgtagtcagagctacttgggaggctgaagcaggaggatcactggagcccaggatgttgaggctacagtgagctgtgatgtcaccactgcactcagcctggggaatgagatgtccacagggactttgaaaagcactgatacattcctgaggatctagaaggccaggcgcatgcccaagtaagacctgagagggctccgatccctcccctctggctgaccacaaggccacatgcaagaaagcaatgaaggcgaatacagaatcatgaactgcccagaaacgataaaacagcaacaacaacaaaccctgctgtggggatctctgatgtccagtgttgccaccttacattatctaaaatgttcattttccaacaaaagagacaagacctacaatgaaacagaaaagcatggccacccaggaaaacagcaatcgtagaaccttccactgagaagccctagatgttggcgttactaaacaaagactttagccgttataatatgttcaaagaactaaagaaaaccatgtcaaaagatgtaaaagaaagtgtgaaaatgctgcctcaccaaataaaaagtatcaataaagaaaaaactataaaagaagaaccaagcagaaattcttgagttgaggagaaccataactgaaatgaaaaatgtactagaggaggtcaatagcagattagagctggcaaaagaaagaatccataaacctggagctaggttggttgaggttctccagactgaggacggaaggaaagctgaacacagtacctatgcagcgaaaagctgaggagctgctcactgcgtgtagagctcaactaactctgatacaaaaaaaaatgtgatacaaaaggttttatacacaaacgtgaacttattctgaagccagcctggggcaaggagcaagacacatcctgccttttaatgtgccatttctcctttggaggagagaggggcattttcataaggtgtgttgtgggggtggggggagtgagcaatggcggttttctaccgggcagttatcaagttcccagcagctgagttggcgcctttccgggcagaaaagtggccgagtgggcatgctttctccatgccttcctagtgggtgaaagacaaacccctagagggtggaagtttcgaagccaccccctggcagggagagttccctggtgggtatgctttgggctgcaaatctactgccaagtctcaggaaagatcagctggaagatcttgccctgttctcaatcaaacctccatcagcctacctccatttacagattcttccttttgcccagcagggaatgtctggagaggggtaggcgaaaggtgatatttgcatttctaaagggctaacaggaaacaggaaacacggccgcggtgaggggtgagggatgggaagaggagaagtgaaaagaaagtaataagaaaactaatataactatctcttagaaaatgggagtactcagttacacccagatgggttcactagtgaacgatgggttctaccaaacatttatgggaaaaattataccaattccctacaacctcttccagaggacaaaagcagagagaacacttcctaactcattctctgaggccagcattatcctaacaccaaaaccagacagacattgtaagaaaaaaacctaaaaaccagtatctcccgtgaacataaatgcaaaattcctcaacaaaatattagtgaatcaaattcaactatgtataaaaagaatcacagagggtgacacaagcgagatggtagagaaggaggctcctggtgctccccttctcccatggacacacggtaaaactctcatctacacacagatcaactccctctgaaagaaacccagaaaccagctgagagaggcctgcacagggggcaatggggagaacacccacatcgcaaccggttggaaaagctgagacacactcgaaccacaagccccaccccagacacagtaccttactgtgaggaaggaatccctactcccagctttctcctggagaggggagggtttggaccacacataggcagccccagcttttgcagttcccactcaagggcttggctgctgggtcacctagctctgggagcagacatgggttagcagttatgaatcctctgcgaccacagaggacaaagaggcagttttaaacgggcacgtgagcacttccagcagctgtgctcagcacagagcaaacaggcagaaatgccaggctcccagttcctccctggaaggatatgtctgcgggctctcctagctgttgcccgagggatgggcttctattaataactggcctgcacctggagccaatgaggcaggtaaacaatagatttccaggagtctggacaggcctgtgggcaagtcccatgccttctcccaccccctgctgtatggtaaaatcaggtctctaacttcacacattgagtacacatttacccctctcaaatgaaggtctagctcctcaaccaccgagctttgggagctgacaaggctctgtatttgtaagtcccacaggggcacagagaccaaagaacatccccccaggcccagtgcagcgtgaacaggcaaaaaggcccggctcctactttctccctagaaggagtttgtctgcacagtgcagctgctgccctggggtttctatgcatctgggagctgacagagcaggaaaccagtgctcctctgagaccctgaacaggcaggtgagcacctccacagctgctcccactggtttgctcaacagatagcgtcaagcttccaactaacctgtccgtctctaagcagagaacagccagcatttgctaggcccctgggggtgacaaagagtaaaacaatgcatgaaggagtgtgcagtttaaacttgagtgcaggcacttgccacagatcctctctccagcattttgcagagcgagtggcagataaactcatgctcccagcttttccctgaggatagaataaactggaacacacatttaatgccccaacgtctccagctgcacctcaaggggctggtttctatctcccctgtctggggcactgacaggacatgacacattctaatctcctgagggccgctaagaacatagatgacagtttggacaacacaaaaggtcaagaggtgctccgagtgtctggcagggctaattggtaagttcgtctcttatacaaggcccgtgggacaagactgggagaggtatttttcttttttttttttgagacggagtctcgctctgtggcccaggctggagtgcagtggttcgatctcggctcactgcaaactccacctcccaggttcacgccattctcctgcctcagcctcccaagtagctgggactacaggcacccgccaccacgcccagctaattttttgtatttttagtagagacagggtttcaccgtgttagccaggatggtctccatctcctgacctcatgatctacccgcctcagcctcccaaagtgctgggattacaggtgtgagccatgatgcccagcctgggagaggtatttttcttaactaaagtacagaaaataacagagaatcaagaacaatgaagaaacagagaaatctgttccaagcaaaagaacaagataaatctccagaaaatgcccccggtgaaatgaagataagtgacttaccttacagacaattcaaaataatgatcatgaagatgcttaccatgtctaggacagcaatgcatgaacaaagtaagaatttcagcaaagagacagaaaaaagttcaaaagaaataatagagctgaagaatacaataactgaaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccgcatgagcacagtggccatagcatgcagcctagctgtgtagtaggctgtcccatctaagtttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacatcccaatatagctatctaaaaaaaaaacctgacctatttgtgaattattttgtagaacatgttttctcttttttattcctttattctgttttcctgcagttccctaactgtggtggaataagcttggaggagatgccttcacctactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccattagttcctctcttcactctctaagcttcccatcccctttggatcagcagccaggaacccagtgggagggtatcttacggggcacgttgtacttctgcaggcagtaggccagctccaggggccacactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggctgcatttaaaatcacccaaagagggcttttaaaaagtaccaatacctggccgggcccagtggctcatgcctgtaatcacagaactttgggaagctgaggcgggcagatcacctgaggtcaggagattgagaccagcctggccaacatggtgaaaactcgtatctactaaacatacaaaaattatccaggtgtggtggcgggcgcctgtaatcccagctacttgagaggctgaggcaggagaatcccttgaacctgggaggcggaggttccactgagccgagattgcaccatccctctccagcctggggacagagtgaggctttagctcaaaaaaaaaaaaaaaaaagtaccaatacctgggccgcaccccagaccaacctaagaagttttagaaataatgtgtaggccagaatatgcagaagccgatctttcctctgccagcttttgagagaagatctcaaaaagtccaagtcactgtgaataactgaatatattaaaaatgaaataatacaggccgggtgcagtggctcacgcctgtaattccagcactttgggaggctgaggtgggtggatcacgaggtcaggagatcaagaccatcctggctaacacggtgaaaccccgtctctactaaaaatacaaaaaaaattagccaggcatggtggcgggctagtcccagctactcgggaggctgaagcaggagaatcgcttgaacccggggggcagagcttgcagtgagccaagatcgcgccactgccctccagcctgggcaacagagcaagactccatctcaaaaaaaaagaaaaagaaataatacaaacgcttatcagcctgaagaacagtcttacctcttcaatatcctggcgaagtccacattcattacaaacacctgaatcaaggagttaaggcagcaggtctgtccaatgttgtgtaaaccaaccaggcctataaggggaagagaaaaaaatgctgagggcaaggcctaggtaaagaagttgacaaggctgggcatggtggctcacgcctgcaattccagtactttgggaggccgaggtgggcggatcacctgaggtcgggagttcgagaccagcctggccaacatggtaaaacgtgtctctacaaaaaaatccaaaaatcagccgggtgcggtggctcacgcctgtaatcccagcactttgggaggccaaggcaggtggatcacctgaggtcgggagttcgagaccagcctgatcaacatggtgaaaccccgtctctactaaaaaatacaaaactagctgggcatggtggcacatgcctgtaatcccagctactcgggaggctgaggtaggagaatcatttgaaaccaggaggtgaaggttgtggtgagccgagatcacaccattgcactcctttctgggcaacaatagtgaaactccatcaaaaaaaaaaagaagaagagaacttacagcagggtgtggcgtttcacacctgtaatcctagcactttgaaaggccaaggtgggcagatcacctgaggtcaggagttcaagaccagcctgggcaacagggcaaaaccctgtctctactaaaaatacaaaagctagccaggcatggtggcaggtgtctataatcccagcttcttgggaggctaaggcagaagaatcattggacctaatttattgatttttttgaacttggaatatggtgtcatgacaaaatcatgccactgcactcaatcctggatgacagagcaagactctgtctcaaaaaaaaaaaggttactttttatttcctgaaaagcttgacttcctgacaatgaaagtcctaaggagcgagtggcagaagacagctggcagctggcagtcattggtggggcaaaggcagagataccactgctgactctactgggcctcgggcctcagcgctcatgggaagggaccctctttcaagcttttggaggggtaagggagggccaggtaacagtgcctacatcttaggcaccgaaaacaactggagctgcttcatgcagtcaagaatcccctgaagaaggaaggcagttacctccctattctccagatctcttcagctggcctggctctcatcctttccaagacctggctgtttgctttgcatttagttatatgagctaattcatatgcttctaataaatgcctttcatccttctccaaagttagccctagagtatattgctgttgtttacaatcaaaaagccccagaggtgtactctccaattctcttaataacctcatttttctgtcattacccctgttttagtacaagtagctgagcttcagagaagttaaaagatgtgcccaaggtcgcacagctaatgagtgtcacagtcagaatctgaacccaagtctgtctgatgtggggtcatgacaagagcatgggttttcttgggagaaaaaaatgacttcaaatccccacttcccgcataaaaatgcacaatgggtgtagcaatgccgaagccacagagctattgaggatggatggaggtgacgcataggaaagcacatggcctagggtatgtattcccaacactttgggaggccgaggtgggcagatcacctgaggccgggagttcaagaccaacctgaccaacatggagaaaccctgtctctactaaaaatacaagataagctgagtgtggtggtgcatgcctgtaatcccaactacttgggaggctgaggcaggagaatagcttgaacccaggaggcagaggttgtggtgaaccaagatcatgccattgcagtccagactgggtgaaaagaacaaaactccatctcaaaaaaaaaaaaaaaagaattaagaaaaaatatttgaacacttctttttatccctaatttattcatgtttttgaacttggaataggaacactactgccaacaaaagtaattagagaatatagatgttaaatctattctctaaatgaattattgcttattttaaaattgcatattaattaattacaggaaatttggaaagtaagagacatatgaagaaaaaaaggtaaaaatgatttgtaatccctctgagagttaccctttaatgccatttttggtatatttcctctcagttctttccccctccaccaccagtatgtgtgagtagtttatgttttataaagctgggttcatacaatatgatttcttggctggtgtggtggctcatgcctgtaattctagcactttgggaggctgaggcaggcatattgcttgagcccaggagttccagaccagcctaggcaacacagtgagaccccatctttacaaaaagtaaaaaattaggtggtggatatggtggcacttgcctgtagtcccagctacttgggaggctgagaccagaggatcacttgaacggaggaggagtctgcagtgagcctagattgtgccactgcactccagcctgggtgacagagtgagaccctgtctcaaaaaacccaaaaaagatttctctataatttctttttttattcagtaaaatattgtagttttctctatcttgattaaacagtctaaaatggttttaatgtcaccatagtattccattttataaatttgtcaaaatttatttaacccttattgttacatttccattttttaaaatagtgctgcagctgttgatttgaaaagatacttttttcaggtagttgacaaccaaaatatccccttgatgggttccagcataccccatgcctcagtatcacacagtatacctttgtaactaacctgcatggtacccccgattctaaaataaaagttgaaaaaaaatcatctagtgttttaaaacaaattatgtattatttttgggccaagcgtggtggctcacacctgtaatcccagttctttcagaggttgaggtgggaggatcacacaagaggatccactgagaccaggagtttgagaccagcctgggcaacatagtgagacccccatctctacagtaattaaaaaaaaaattagctgggcatgatggcatgcacttgcagtcccagctacttaggaggctgaggtgagaggattgcttgagcccagaagtttgaggttacagggagctatgatgatgccactgcactccagcctgggtgacagagcgagactctgtctcaaaaaaatatactattttaaatttataaatgacaattgaattacatttatatagtacaatgtgatgtgtgatgtatgtatactgttaaagagaaaagcctttgactaaatttgacagagtttagttgaacagaaaaaagattcatgaaccaggtagcactgagaaccaaaagtggttcagagatctctgctccacaggtgggcagggaatatttatagccagaaaacgtaagtttcattgagaaatagcctgttggttacagctctgcagttgccttgtttgaacatgtttttggcagcttgcagcctgtgaagggctgagagctcagctgctgtgattggctgagactgggctacttattccaagggcatattctcaggttaggttgcagtttgttttgtttacctatgtgaacccccaatagctgagacaggtctcagttaatttagaaggtttatttgccaaggttggtgacatgcacccataacacagcctcaggaggtcctgacatgtgcccaaggtggtcagagcacagtttggttttatacattttaaggagacatgagacatcaatcaacatatgtaagatgaacattggttcggtccagaaaggcaggacagctcgaagcaaaggtgggacaactcgaggtggggagggggcttccaagtcttagatagataagagacaaatggttgcattcttttgagtttctgatgagcctctccaaaggaggcaatcagatatgcatttatctcagtgagcagaggggagactttcaatagaatgggaggcaggtttgcccaaagcagttcccagcttgacttttccctttagcttcttggggccccaagatttattgtcctttcacatctattaagttagattacagtgtgctatatatggaggcagctttattttattttaattaattaattaatttatttgttggtgatgttgatttctcttgttttaaaatcaacattataggctgggcatggtggctcatatctgtaatccctgcactttgggaggccgaggcgggtggatcacttgaggtcagaagttcaagaccagcatggccaacttggcaaaactctgtgcctactaaaatatatgaagattagctggtcacggtgatgcacacctgaaattccagctactcaggaagctgaggcaggagaatcacttgaacccaggaggcagaggttgcagtgagctgagattgcacgattgcactccagcctgggtgatagagtgagactccaactcaaaaataaataaataaataaattaattaattaaataaaatcaactttacggagaaaaatttacattcaagaaaatacgcccattttaagtgtccagctggatgaattttcagaaatgtgtgtaccctcatgaccacttcctcaatcatgatacagaacattcccataacctggaaatccctgtggccctttgctggcagtttccccacccagccccaggcaacccctgatctgccctctgtcactgtagactagttttgccttttctagaatctcatatagagggagtcatgcagtatgtactctcttgtagctaatgtttttgaggttccttggtgttactgcattgttttctattgctgagtagtattccgttctactcagtaccataatttgctcatctactcttctgtggctggactttccagtttggcgctaatatgaattgtggaggcagttttagaccaaatttaacttaacaatacaatatgaaaagattaagtcaagctaatgaacatacctgttacctcacttacttggcattcttttaagttgatgcactagaaattttctctcttagaccgggcacagtggctcacacctgtaatcccagcactttgggaggccgaggcggggggatcatgagatcaggagatcgacaccatcctggctaacacagtgagaccccgcctctactaaaaatacaaaaaattagctgggcgtggtggcaggcgcctgtagtcccagctacttgggaggctgaggcaggagaatggcatgaacccaggaggcagagcttgcagtgagccgagatcacaccactgcactccagcctgaaagacagagactccgtctcaaaaaaaaaaaaatttccttagttattttgaaatattcattattattgactatagtctcctgctgtgcaatagacctcaaaacttttttctcctgcttggctgaaactttgtaccttttgaagaggaagtctccattcccttgttctgccacctcgccagctctggtaaccattattcttctactgaatgaattcaactttttttttttttttttgagatgtctcactctgtcacccaggctggagtgcagtggcacaatctcagctcactgcaacctccgtctcccaggtttaagcgattctcctgcctcagcctcccaagtagctgggattacaggcgcctgccaccatgcccagctaatgtttgtatttttagtagagacagggtttcaccatgttcgccaggctggtctcaaactgctgacctcaagtgatccacctgcctcagcttcccaaaatgctgggattaccagcatgagccagggcgcctggcccaaattcaactttttttttttttttatgagtgagcagcagcaagatttattgcgaagagcgaaagaacaaagctcccacagtgtggaaggggacccgagtgggtagctcccaaattcaacttttaaaagattccacgggcatgtgagattatgtggtatttgtctttctgtggtatttgtatttcacttagcagtatgtcctctagatttattcgtgtcattcccaatgacagagttttgttcttttttatttttttggagatggagtttcattcttgttgcccaggctagagtgtaatggcatgatctcggctcaccacaacctccacctcccgggttcaagtgattctcctgcttcagcctcccaagtagctggaattacaggaatgtgccaccacacctggctaattttgtatttttttttaatagagatggggcttcaccatgttggtcaggctggtcttgaactgccgacctcaggtgatctgcccacctgggcctcccaaagtgctgggattacaggcatgagccactgctcccggctgagttttgttctttttaaggctgaatagtacttcgttgtatgcgtgcaccgccttttctgtacgcattcatcttaggctgattgacttaggcagattccacatcttggctactgtaaatggggccgcagtgaacatgggagtgcagacatccctgaacacactgatttcaattcccttggatatattcccagaagtgggattgctggctcacatgatagttctatgtttagtgttttgaggaacctccatgccattttccatcgcggctgtactacacaccggcagtatactaggattcccctttctccacatcctggccaaaacttaccttccatctttttcataaaacttgttctgatgagagggagatgttatgtcacggtggttttaatttgcattttcctaaagatttaggttgccactggtcagctccaggccccagagcttcttcaactgaagaagtacttgctgtctatagtaagcatctcaaactttaacgtgcatgtggatcacctgggaatcttgtcaaatgcagcttccaggtaagtgggtctgcagtggggcctgatattttgccttttgaacaaactcccagataatactgatgttactggtcccaggacctgcctttgaggtagcattttttcatgaacctattggctgtttgtatgtctacttttgaaaaatgtgtttggttcctttattcattcttacattggcttattggttcttttgctgttgagttgattgagttcctcatatattttggatattagccccttttctaatgtatggttagcagatattttttctcacgacgtgggttatctctttgttacttgttccttttgctgtgcagaagcttttcagtttgatgccatcctgtttctatttttgcttttattgcctgtgcttttggggacatacccaaaaaatcattgcccagatcagtgtcatggagcttttcctctgtgttttcttatagtaattttacagtttccggcataatgttaaagtctttgatccattttgggttgattttggggcatggtgtaagataagggtctaattttattttctgcatatgaatagccacttttcccagcaccatttattgaatagagtgttcttaccccttggcgtgttctttgtgcctttgtcaaaagtcaatagacagtcagctgggcacggtggctcacgcctgtaatcccgcactttgggaggccaaggcaggtggatcacctgaggtcaggagttcaagaccagcctggccaacatggtgaaaccccatctctaataaaaatacaaaaaattagccgggtgtggtggcaggcacctgtaatctcagctactcgggaggctaaggcaggacaatcgcatgaacccaggaggcagaggttgtagtgagccgagatcactccactgcactccgtccagcctgggcaacattccttctgtgttctgggatatatattcttgagggtattcccatctgtggatagttgccagttagatttctgtggtggggaagtggagctagagtattcttttcctttttttttgagacagcatctcactctgtcatccacgctgcagtgcagtggcattaacatggcttcattgatctcttgagctcaagtgatcctcccacctgagtctcctgaaaagctagggctacaggcatgcatcagcatgcccggctaatttttaattgttttgtagacatgggttcttgctgtgttgcctaggttggtctcgaactcctggactcaagcagtcctcctgccttggcctcccaaagtgctgggattacaggcgtgagccactgctcctggtctgtttcttttgtttagtatttttgtttgctttgtttcatgagctgctattttgactacagttttaatatttttagcaattttttggatatgcagaaatttaattcttattcatcaaatatattttagtattttgtgtgttttttagatttccttttttaggagtctttccaaccataaactgccaaatagaaatacacacacacacatacacagaggctatgaatagacaactaattgaaacagaaaaaaattgattaattaaagcacctatgggatttttctccagccaaattagcatttttatttaaaaaaatcttttagtgttatttagcctacataggaagaggcttacttatgtagttgataagagtgtgaattgatcaactttttggaaaataatctgccagtataattaaaattataattaaaatgtatcataggtcagttacaccactttgagaatcctatactacagaaaagaagaaatataaaacaaaaacatcagtgggatccatgtatattgatgattattgtagtcatcagtggtgggaatttttaaaaacaaccttaatatccatctaatagggaataaagaaatcagaacttatctacaatgcgcattactacacagaaattcaaatgatacatttgatctacattagctggaattagtaatgtccatgtactctaatgggagaaagaaaattactaaataatgtaagatttgagcacgttctttaaacaaaacaaatcaataaagccctaaaaggacatactattgaaagcaagtcacaaaatccagaaatggcagggaaaatgttcaacaatttgactatgtaaaaatgaaagtttcttcaaaacaaagataatataaacaaaataaaagttatgatacagaccttaagaaacaaacttgctaattatatggaattaataaatgtgcagaatatataaagaatatcattacatgaattagaaaactagtaaatcataatgaaattctcagcgagaaatacaattggccagtaaacatatgcaaaaatgcacaatctctctaataagtggagaaatccaaattaaaaatggaaatatttcttaatcataaaattggccaaggttagcattggtcatttcctctgtaactaagggtgtgtggaaataggaactctcatatactgatggtgggagtataatatcattaaatttttttgaaacacagatttttaattttttatcaaaatatggccaggtgcagtggctcacgcctgcaatcccagcactgtgggaggccaaggcaggcagatcatgaggtcaggagatcgagaccatcctggctaacatggtgaaaccccgtgttatttgtaaaaatacaaaaacaaaattagctgggtgtggtggtgggcacctgtagtcccagctacttgagaggctaaggcaggagaatggcatgaacctgggaggctgagcttgcagtgagccaagatcacaccactgcactccagcctgggcaacagaacgagactctgtctcaaaaaaataataataatattaaaaatttatactttgcctcagtattttatttttagaaatcaatcataaaagaaaaaacccacctaactaaggtaccaaaaagatgaatatacaggtatgcccaggatagtgtaggtaacggtaacaaataactgaatccaacataaaaattccacagtgaaaaagtgaccaaattatggtcagataccctgttgaataatgatgcaactataaataagaatgagagagacctatatgcactcataagcaatgatcaccacattctattttatatggaaaagccagttagggaacaacacacaaagcaggattacgttatgtaaaaacatgggcatgtctatctgtgtgtaagtggatgtagacgactgagtgggctgggagctggcggtgacacatttcattctacagacctaagcagtatttgaatttttataacaatagcatatgtgtttcttatgtgatttactagaaacaatttaatttcttcagttgtaaaaggtgtattttaaacctatataaaggtacatggagatcgtcattcagaataacaaaataaaaagcaatataaagacacaaatagatatagtacaatattaaatactacaatattcaagatgatattaaaattatatatatctacatctatatgcatgtaaggatctcagtaaatgatattgtctaaaattaaactgtggtaatttttgcagacctctgtgaatatattagaaaccattgaattgtgtgtacactgtgtgtgggtgaaatttattgtatttgaattatatctcaaagttctgttaaaaaatgaatggcttgatattctagtgctaagggatggttttatttaaaacataaactaatagtttccagcagagtcccttaaaaatattacagcagggatttccagatcacactcactcccacctttttagaatttttgactattttccaaagtattgaattcaatgaggtgcaggtggaagaaagcgtttacaaagtcagtgggttacgggagagctggtgtgggttgaggcagagtggggagagaggctcctttcaaatggaagcctctggaacccacagacggcaagcgtaaggcagggcaatcttctggagacctaccagagaaaggctttagacccaacactcccattcacaaacatggacaggggcatctcagtgtttccttaacttcactctttctatattgacacaaggaaataattaaaagggggtaattctggtttagtttatttcattaaattatcaacaaacaacttttgaaacaaaaactattaaagtggaactcaataaaattactaggtttaataatctgtatctgtgactcagatacagatcaggcaaaccagctgtggatgaagctcccagctgtggatgatgcccccagacatggatgaagcccccagctgtggatgatgcccccagatgtagatgaagccacaaatgatgcctgtgtggacagacagaatgatggacaggcagatgaatgtgagggttttatgtgaaacaagtccacttggttgttgacaagatgctgttttaaagtttcattttgccatactttgaatagcttttcattagctaaatttagccacatgtaaaatcactaaggcagacacctggagttcccatatgaaaatcaaatgtaaaccagcagtgacctacttcaatgtgatcatcggaagtcagaagttgagctcatttttgatgtttaaagcctgcataatattcactgtgttattattcagtgtattactatttccttcatgatggaaatttggtttgccccaactttctattctatcaaaacactgctacatagaaaatccccatgcacatatttctcctaattgtggaaatattttacataaaagactctagacatgggatgaaattcccaggttattggaattttaaaatagataggtactcccaaattgccgtcttacaaattatatgaattcgtaagcttccaactgttatggagttacccattttgagaaatctgtgctaaaaggacccaaacaatgctgatgacaatgatcaggataataagtacgctgggaagacaacaaaatgatttaaatcttagacaagtcattctaggtgtctccactgtttcagttcttgcattcattcttgtggtatcttttcccttttaccaataaaaaagctccctgacatcacattgtggcagtccccatggtttgccgcagttactgcgggactgaacgaaggaggacgaatgaagaaatgaaaaccaaggaaaaaaggagctgtttaaagaagggtccagggaagaagaagagggctcccagcttctagtgagcaagggcagcagccctgagcttctacagcccttcatatttattgagtagaaagagcagggagcaggaggtaatgattggtcagcttctcaattgatcacaggttcacattattgctaacaggtttcagatgtgcctaatctcaagaaacgccgcgcctggggcatgactgccctcagcattccctctgggtggcagacgcagtttgccaacattctgcattcatgagaacagtttactgtttactcatataacctccagtggtacaccgagttgatcatgaccctccctctttcggcctgcaacatcacatgaatccaatgagtattggttagtaaaatgcctatgactagtcatcttcatctatgcaattaaatattaattcatcaaacacttcaaatgtaagcaattaataattagtgaatgaaaaatacataatacatcaattagaaaaaaactctattaaaaagacatttgtgtgataaaagagattgccatttttgtatttttctacaaagttaaagaaaactaagtcagcttatataagtgaattttaaaagcctttaggccaggcatggtggttcatgcctgtaatcccagcactttgggaggccaaggtaggcagatcacctgaagtcaggagttcgagaccagcttggccaacatagtgaaacccatctctaccaaaaatacaaaaattagccaggcgtggtggcaggtgcctgtagttccagctactagggaggctgaggcaggagaattgcttgaacccgggagacggagattgcagtgagccgagatggtaccactgcactccagcctgggcaacagagtgagactccatctcaggaaaaaaaaaaaagggcatatatatccattatttcactgggccttcacacagccctgctagtcaaccctcgagaattgaggaatcagagaacttaggaacaagaacatgacctgggacttcttatgtaagtgagaatcttaggctaaattgtcttgcggtaaatgcctttcccatcctcagaagtctatagtgagcagaaagcagtaacagcatcctcccttccactcttcccttcaggctgaacacatccctgtccctacagcctttgcagagacacaggtgacagagcactcaatatagaatccctgggctcacactggctttcctacagacacaggggatccatgaggcccacagtgacatacacatgtacacaaggatgcacgtactgacactgatgagccctggaagtcaacacagagtggcatacagaagaacacatgcaggcacacacacagccacaactggacctgcgaggtctacagccccacaaatgaaaagaggtgcataccatctcacaacaaactagaactttgagagaaccacacacacacacaggtctacaaattcacctgaacaagacgccgtccatagtcactggcgtaaggcatctactcactatcacacagaacacactcaggcaagcagacatagatgatacatccacaatctacagagatgaactgcagagttacatgcacagatatgccagtcatacattcagatctgtgtaaacagtgaggcacacacacacatacacatgtgcacttatacagaaagactcagacccagccaggcatggtggctcaggcctgtaatcctagcactttgggaggtcgaggcgggtggatcacgaggtcaagagattgagaccatcctggctaacatggtgaaaccccatctctactaaaattacaaaaaaattagccgggtgtgatggcgggcacctgtagtcccagctactcagaaggcagagattgcagtgagctgagattgcgccactgcactccagcctggacaacagagcgcgactccatctcaaaaacaaaaaaagaaagactcagacctgacctgttagtcaacagccagatgccaacagataatcacattagactcatcagcaagcacaccgtgcacacaagttccactcccatgtacaggttcctgtcccatgtacacaagcctgcacacaaacacgtatccagactccagaactgttgagacagtgcccacatacacactcatagagtcacctgtgcacaggtgcacgtacacattgtttcacagaggcacaccaggacagaaacacataagaaatgtgaggcaaaagcggacccacacctacacctgtaagatacacagagaaacaaacacatacacaaacttacacatagactcatgcactgtgtaatcaacagttctataccccaccaaggctcttgtcctggtgtgtccagaattggtgggttcttggtttcactgacttcaagaatgaagccacagaccctcgtggtgagtgtcacagttcttaaacgcagcgtgcgcggagtttcttccttctggtgcgttcgtggtctcgctagcttcagaagtgaagctacagaccttcgcagtgttaacagctcataaaggcagcgtggacccaaagagctagacacaaaagttctccacgtccccactagattagctagatacagagtgtccactggtgcattcacaaaccctgagctagacacagagtgctgattggtgcatttacaaaccttgggctagatacagagtgccaattggtgtatttacaatcccttagctagacataaaggttctccaagtccccaccagagtagctagatacagtgttgattgatgcattcacaaaccctgagctagacacagagtgctgattggtgtgtttacaaaccttgagctagatacagagtgccgattggtgtattttcaaccccttagctagacataaaggttctccaagtccccagcagagtagctagatacagtgtcgattgatgcattcacaaaccctgagctagacacagggtgctgattggtgtgtttacaaaccttaagctagacacagagtgcccactggtgtatttacaatcccttagctagacataaaggttctccaagtccccaccagactcagaagcccagctggcttcacccagtggatcccgcaccggggccgcaggtggagctgccttccagtcccgcgccgtgcgcccgcactcctcagcccttgggtggtcgatgggactgggcgccgtggagcagggggcggcgcttgtcggggaggcttgggccgcgcaggagcccacggcggtgggtaggctcaggcatggcgggctgcaggtcccgagccctgccccgcggggaggcaacgaaggcccggcgagaagtcgagcacagcagctgctggcccaggtgctaagcccctcactgcccgggtccggctggcagctccgagtgcggggcccgctgagcccacgcccacccggaactcgtgctggcccgcaagcgctgcgcgcagtcccggttcccgcccgcgcctctccctccacacctctcggcaagctgagggagccggctccggccgcagccagcccaggaaggggctcccacagtgcagcggtgggctgaagggctcctcaagcgcggccagagtgggcgccaaggccgactaggcgccgagagcgagcaagggctgtgaggactgccagcacgctgtcccctctcactgggttgctattaaaaatgggcgctgaatataaaaattaaccgggcgtggtggtgcatgtctgtaagtcccagctactccggaggctgaggtgggagaatagtttgagcccgagagactgaggctacggtgagccgtgattgtgcaactgcactccagcctgggcgacagagtgagacccagtctcaaaacaaaatcaaacacgggcgctgccctgggcaggggaggtctgggcacagctgtgctgatgtgggcagtggacaggtgtcacgtgagagcctgtggccaagcctaagctgcggttaaggtgggaggctgaagggtttggagtgtgcaccaccccggaccacctctcagtaggaatgtggcaatgcacttcggtgctggattcctacttctggctgtgtgatttgcgacacgttaccccacgcacctgtaccacaacttcctcatctcccaaatgggatgacagtagttagcaaacctccctggactgctgtgagcattctgccagaaaaatgtactccaagctcttgaagtaggcctggcgtttggttggtgctcagtacatattcaatgtttctgtcgctggcgtcatcactgtgttcatggcagagctctgtgccgccaggactgggccgccacccagaccttcctttcccgccccaggggtgaactgtggacaggaccctctggggggactaggccaaggctctcccacctctggggacccgcgcccatgggcctcagatatgtggctcgagaagggggagtgggggcagggcccctggaaaacccctcgaggccagacccaccactcccaatatccgtaagaccaggggcttgagtctttcctgcagacagatgtgggcaggaacccacccgactcccagctacgtggggacgtggacgaactaacaggacaaattctagttcctggacaccgccctcccagtatcctcgcaattagacacccatgcagcggcactacactgatccgcacacggagatacacagcgacatccgcccgcaagagcatggtgggtgccggagctcccggctgtgggcccaggaactacatttcctagaaggatgtgctagatactcgttcgcgtcgggacgcaagcaccggcccgaactcgctctaggaaatggagtctgacgcctgcgcggcgcaaacgctcccgggaggtgtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatctttttttttttttttaaatggaatctcactctgtcacccaggcgggagtggtgcaatggcttgatctccgctcactgcaacctctgcttcccgggttcaaactattctcccgcctcaacctcccaagtagttgggattgcaggcgcgcgccaccacgcccggctaatgtttgtatttttagtagagacggggttttgccatgtttcccaggctggtcttaagctcaagcgatccgcccgcctcggcctcccaaagtgctgggattacaggcgtgagccatcgctcctggcctcctgcttctttcttccccgcgcccaatcatttgttcccactcagacgtgcttgattgggggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggtgagtggctgtgtgttcttccttctttatgaagagggttggcacattccctccccagccctggatcgtcagccttccacagaccttcacccgggtacctgctggccagtcctcaggaagctctgggcagtgggaacagctccaagtgaagagtccagatgttgcccgaggtgtgccctcgagatgtgctctattgaatgtctcgcccagtccaattcagtgggtcagttgctggggatctctctgcccagcgctgtgctgggagctctgaggagtggttttagtggaatctgagaaagtagttgacggctcacatggggtcgctttgcctatccacgtgctggccaggggttggtgcaggatgtttgcacggttggtttactgggactggaatcagacaggggcacgtggagcagctcaggaagggctggattgcagcacttggttaagagtggcggtaggggacacatccctgtgtgctttcctctgtacccagcccctggcatggggccttcatggagagtcctggagatttagagaatctgggggctcagcaaggaattggccctgggaacttctgcagccaaatgggacccagatccctccttttacagactgtgaactctgttcctcattttgtttttctaccgcaaccacctcaccccatggttgtatttagaagggtgcagttgacaaagagagcacagtagagtgaaagatgtggaggaataaggggtctttgggtttttgttttttttttagcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatccaaaaaaattgataaagggcagtttgggacaagaggaaatttgaaaatgggctgtatcttaggtcatattgtatcaatatgaaatttattgcatgtgataatagtactgtgattatgtaagagaatatccacaggagatacaagctgaagactgtagagtgagacatcatgatgtctgcaacttaccttcaaatggttcagcaaaaaaaaatgtgtgtgcatgtatgtatgtctgtatgtgtctgtgcagctccgtctaggtggtagggccctcatgcatgtgttattcctattcctaaaatattagcttgttagatctttgaataaccagttgactctcctgagtacacatcagctttggcattttctcttgacagtctcattctcactcacagttcaagttgttctgtctcctgggacatcttgtgtggtctgttctgacttctctgctagtgtcattaccacatcagcatctgattccaatgcatactgtctgggttttttattcctttccctgcagaatgatgacacattagacatggacttctcccagtggccagaaatacccatcaaaaaggcctgtgcgggcctcagaccctaccctactcttgctggttttgctccccacactgaagccatgtagcctctgacagcctcactggccaacaccatattctgatacctgtggagctatttttttgtttttctttctttttctttttttttttttgagacagagtcttgctctgtcgcccaggctggagtgcagtggcacaatcatagctcactgcagccttcaactcctgggctcaagcaaatcccccacctcggcctcctaagtagttgggaccaacgtgtgtgcccccacacctggcttggagccttgtttcagcccattttctccttccctcggctatcgtcatccttcatgcctgcatgcctcagttaggggtgtgttctcagcatttgtcctcatctctacctcctcatctgaaatccagtgttttggggggtaaggttttattgaggtgtaatttatatacagcacagttgtacaattttaagtatacaatttgatgaggttgagcaaacgtatacagttgtgtaaccagcaccacaatcatgatatgggacgtttccatgacccaaaaatgtcctcatgcccctgtgcattcagtggtctcccctctccccttggtaaccactatagttttgctgtagattttcctctttaaggatttcatatggaatttatattatgtggtcttttgtctctgctttatttcgcttagcatatgcttttgagtttatccatattgttgtgtgaatcagtagtttgttcctttttattggtgagtaatattccatttgtattagtctgctagggttgccatacaaagtatggcaggagggcttaaatgacagaaatgtatttcctcacagttccagaggcaagaaatctgaaatcaaggtgtcagcagggttgatttcttctgaggcttctccttggcttgtagatggccaccttttccccgcatcttcacatggtcttacctcttctatgtctgtgtccaaatttcctcttcttatgaggacaccagttatattggatcaaggcccactgcattgaattcattttaactgaattacttctttaaagaacctctctccaggccgggtgcagtggctcacgcctgtaaccccagcattttgggaggctgaggtgggtggaacacttgaggtcaggagttcaagaccagccggccaacatggtgaaaccctgtctctactaaaaatacaaaaatttagctgggcgttagttctcgcctgtagtcctagctactcaggaggctgaggcaggagaatctcttgaacccaggaggcagaggttgcagtgagctgagattgcaccactgtactccagcctgggtgacagagtgagaccatgtctcaaaaaaaaaaaaaaaaaaaaaaaacctctctcggagttaccaagcattgagacataagaatttgaggtgaggggtatacatttcatcccattgctccattggatggagcaaactgctccgcagtttgcttatccattcaccagccgatggacatttaggttactcataggcttttgctattacaaataaacccgctataaatatttgagtacacgtatggctgtgcattttaatttctcttgcataaatacctaggtgtgaaattgctgagccatatagtaaatatatgtttgtcaattttattgatcttttcaaaaaacaatttttttgttttattgatttttctctattttctgttttccatttcagagatttctgatccttattatctccttggtgtcttaagattgaaacttactttacttactttagtgtcttaagattgaaacatagatattgatttgataccttttttcctcatatagcattcagcgttgtaaatttctaagcactgcctcaactatatcctacaacttttgttatgtcacattttcacttttattcagctcaaaatagcttctaatttccctagtgatgtattcttcagccatatgttatttcagaatgtgttgtttcatttcctaatatttagggcattttccagataactttctattatggatttctgatttaattctattgtcatcaaagaatgaactttgtgtgatttaaagtctttcaagtctaccaagatttattttatttcccagagtgtggtttatcttggtaaatgttccacatgcccttgaaaaaatatgtattatgcctttgttggttagagtgttatgtaaatatcagttaagtcaagttgaatgatggtgttttttaattgttctgtcagtttttgcattatgtattttgaagctcttttagtagatacatttatatttaggattgctatgagttcttaatgaattaactgttttatcattatgtaatattctctttgtctctgatagtcctctctctgaaatctactttgctattactataggcacttgagctttttttttttaaattagtatttgcagggtttatctttttctatcctatcacttttaacctatctttgtatgtaaagtgggtttctgtagcttgctttttgaattcagtttgacaatctccaccttttaattggagtgtttaaactattcgcatttagtgtaattattaatatggttggatttacatgtcctttttttttttttcttttgacagagtttggctcttgtcacccaggctggagtgcagtggcgcaatcttggctcactgcaacctccacctcttgggttcaagcaattctcctgacctcaggtgatctgccaccttggcctcccaagtgctgggattataggcgtgagccaccccacccggccttgctattagttttctatgtcttatgtcttttttgtttctcatttcctcccttaatgacttcttttgaggtaaacacatactgttctaatatactcttaattcctctgatttcattaatatttttcaccttttagttatttgattggatgctggacattgtgaattttactttgttgagtaggtttttggaattccttgtttctgggatttgttctgggatgcagtgaaattacttggcatctatttgatcctttcaaggatcaaagcaagtctggagttgggtggtggccaggatgcccaggcccagggggagcaggcaggaaggattggaaggcagtcaggtgaggactgcaggtagcctctcttagtcccttggggcacagaacttgctgatatatacaaggtttccttccttagagtgtaataacagtttctagtctgggatcggatccttttgcgttactgagctttgaatagagttgctgggatttttgtactattaatattctctcaaatttttaagtttgaaattcttgactccaggaagcatagcatctcacccaggacttagagcctgatacaacagccatgtacagcccctgggtcccaccgcaagttgccagggccctgtggtgtctattcagacctgctttcccaatctagaaggtggtgtgggaatgcatgccaattcccagcccccctccctgcccctggtccccgaattcagtcatggtcagtgtctacagcacaaccttctggcatgggagaaggtcacctgaggttaaccctttacttgtagggtccttaatcaatctctggctcctttggaaccatggacacagaatcagtcctgggtgagaacctatatgtcatttcaggaatcggtgagtttcaaggatgtggctgtggacttcacccaggaggagtggggtcaactagactcccctcagagggccttgtaccgggatgtgatgttggagaactaccagaaccttcttgccctaggtaaaatccccccagccccaggctgggcgtcggctgtcagccttcttctacatggtagatattaaggagaatcccttcagtgccggccctggtgccagatatatcatggggtgggaagcaaggcctgtgccttggggcactcatggccaggggcctcggccacgccagaagtccccaagggacagcgtgggagctggtagcatccttgcttggtgtttcccctggtcctgggataggggcagggagagaagagaagaaggtgggaccctggagcccagctggctctggaacagtcctcaagcaatgaagtaaggacgtcagcacacgtggggtcttcagagtatacactgggatttgggttccagtctgagaccctcactgcttttggcccagaggacctcctgttcccagagagggtgtccacttcacaggcattgtccttgttagggggcggcctgtaaggtcgactgggcctggagagctgcagcatgcccagcccactttctctccacgagcaggacctccactgcacaagccagatgtgatctctcatctggaacgaggcgaggagccatggagcatgcagagggaagtccccagagggccctgtccaggtgagcagaggcacaggtggaagggtgccagccccagcacccctggtggcacctcctcctatggcccctattttcctccctcagtttgccccggctccatctccccttttcaggtcccccgccagaccctcctgcctgcctcccttcagcacgtactgagcactgcctgtgtgctgagacctgttctgggatacaacagggaacaaacctggccactgggaccaaatggtcacctgctgatggggatggggaggcaggaatagaaatattgagccattggtgttggctgggcagccgggggtgtgggattgggggcagggggccaccagggaaggggcagctggcgttggtcagtgtcagggtcagcatgagcatcagcatcagggccagcgtcagcgtcagggtcagagccagcatcagtgtcagggccagcgtgagcatcagcatcagggccagtgtgagcatcagtgtcagggccatcatcagcgtcagggtcagagtcagcatcagcattagggtcagcatcagcgtcagggtcagggtcaacgtcagcgagggcttccaggctgtggccaagatggcagccctccgtaagggaaaggggactggggtgggtgttgagcagaaggtagtctgcttttcttctccaacattctttttgtagacttctcttctgagttggttgataaataagtggtaaattcggcttaatttattggacagtgactgctgagcatgttaggtgtctagaaagctcgagaaacacctttctgtgggaaaggcagccgataagctgtggagcacagaacacgggggtcggggaaggcagcccctcctccatccccctccactgccacataccacccagccccaacctgcaacagtggctgcagccccagctttctggtctttatttctcaccccagcctctgatgcttgctttgtcctctttaacaagattacaggtttcaaaaaattcatatttttgtttgattcatatatgaatatactgaaaatgaggctgaaaggttactgaaatcctgcataatctttccacccagagatgacggttctctaataactgaccatgtcactgattcctctgggcccttcctctgtgtgcggatagacttctaaagctacatgtggccaggcgtgatggctcacacctgtaatcccaacactttgggaggccgaggcaggcagatcacctgaggtcaggagttcgagaccagcctgaccaacatagagaaaccctgtctctactaaaattacaaaattagctgggcatggtggtgcatgcctgtaatcccagctacttgggaggctgaggcaggagaatcgcttgaacccaggaggcagaggttgcggtgagctgagatcgtgccattgcactccagtctgggtaacaagagtgaaattccatctcaaaaaaaaaaaaaaaaaaaaattagctgggcgtggtggtgagcacctgtaatcccagctactctggaggcttaggcaggagaattgcttgaacccgggaggcagaggttgcagtgagccatgatcgcaccattgcactccagcctgtgtgacagagctaaactccatctcaaacaaataaataaataaagccttatgcaccctcggaagcacagcactcacgccggagtctggctaccacactggccatggcatagtgagcgtcctcacgtgatgtttactgattgcacagtatcccttagatgaatgtgccctgctgtgttgttggccctattgctgccaaaacaacttttttctggcctgggcctcttctctctgctctgtgcaacttccctagactcttacctctcacttggtgtggatgtggtctacactatagcaacaccagctgagctgcagccctgtgtcactgaccatctcgtgggcctctgcttgcatgtctaaaaccagacttggaactggcccttcctcctcctttataaaagcttccaccatccacccaggcttgggtgtttgctgaggtctcatcctctcccccatttcctctcttgccaccttcagtcaacagctagggccatcagttttagcacctaaatggctcttagatctgctgcttcctgttcattttcacagccttggttccagtctgaagttgccatttttcacctgaattattcagatggcctccctaactggcctccctaactgctggctccaaccaccttacacaccaccaaagccaccttcaagacaaaccattatgccaggcacagggactcacacatctaatcccagcactttgggaggccaaggcaggaggaccacttgagcccaggagttggaggctgcagcgagctgtgattgcacccctgcactgcagcctggacaacagagcgagactgtgtccccgccctctgcttcccccgccccccgtcaagacaccatatgatcacatcaccctctgtgcaaaaggcctttcttccccggctgccctctgagtcaggcatctggtcacctcgaacccatccaccttgccagggtcacctctcagccttcctgcctctgcgtgtcttgtcttcatcttactgtctcacctctgagcttctgcacatgctgttcactctccacctggctacctgccatgtgtgccatggccagttccacttgccctgctcttctgcatgtgttggggccacaggcagcaccaccatgcagctctgcccgctgcactagactgctcccttttaagcctggggaggacagaattagaaataaaatctcctgccagctcagaaaaccttgctatagagatagaaaagaaagaaagccttcttattgaataagtgtttaaccagatgtggtgtacaggagagaaagaaacctccccctttgacagaggagacacatccaacccagcacacagggcaactgtcttcacctaaaggaagagtacagctttttgggttttgtttgtttgtttgttttttgagacagggtatccctctattgcccaggctggggtgcggttgcatgatcatagctcgaagcctcaacctccctaggctcaggtgatcctcccacctcagcctcctgagtagctgggactatagacaggtaccatcattcctggctaattttgtattttttgtagaggggtctcactgtgttacccaggctggtcttgatctgggctcaagtgatccgccaccttgacctcccaaagtgctgggattacaggtatgagccaccgcgcccagcctcttgtagctttttgacaagcaggaagttacatcttggactcgactcttggactaggctcattttgcttctgaaaaggtttgcatgcgtctcgagacagagaaagcatttgcaattcccagtgttctaaagggaagcgctggggtgtggggagcccttttttccttttggcaccacagacaatttttaattcatttgttagtcctagctactcgggaggctgaggccggagaatggcgtgaacctgggaggcggagcttgcagtgagccgagatcgcgccactgcactccggcctgggcgacagagcgagactcggtctcaaaacaaacaaacaaacaaaaaacatgtatttgtcctgtgtattgcgagcacctgccatggtattgatacagagcagtcggtcagccgacgtgtccgtgaatgagtgtaatcctcatcaacagctcccaagcttgcccctttctcagcccccttggtgcttgtagctgttccttccgggattcctttggcttctccgcctctcccggtctttgctctctggtagctccttccgtgttcttcctctcccttcttcccgctcttgcttgcccatctcatcctgggcgctcccttctctctgcctgcaccttccagccttggccctggtggcctctcctctcttttctgggcttatctgcatctccaggccaattctcaaatctgaattctaggccaggtttccgcttgctcacagaaaatcattttcaatatcttacagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattaccctctgctttgttcatgtagaactttgcattattttcaacacagtgtatctatagtttttatcttttttccctctttagctttgtagcagatttttttttcaagcatctaaactgtcctcgttatacttcttttttttttaaattatactgtaagttctagggtacgtatgcacaacgtgcaggttagttacatatgtatacatgtgtcatgttggtgtgctgcacccagtaactcgtcatttaacattaggtatatctccaaatgctatccctcccgcctccccccaccccacaacaggccctggtgtgtgatgttccccttcctgtgtccattgttcaattccaacctatgagtgagaacatgcgatatttggttttttgtccttgcgatagtgtgctgagaatgatggtttccagcttcatccatgtccttgttatacttctaaacagaggcacagtgttctctctggtctcttagatactcttttgttggatgttgaagttatttccatggtgcagtggtgtgatcacagctcactgaaacctcaacctccctggctcaggtgatcctcccacctcaacctcctgagtggttgggactttgggactacaggtgtgcgccaccacgcccagctaaatttttggggggggcagggggtctcgctgtgttgctcaggctggtattgaactcctggtctcaagcgatcctcccacctcagcctctcaaagtgttggggttacaggcatgagccactgcacccagtctattgatctttctttttgaaaaatatttgaatatgccctttgtccctctttatattggagtcttgatgtttttcttttatgtatgtaaaaacttttccctgattatgaatattatatgtatactgcagaaaatttttaaaaatcacaaaatcataataaaaatgaccctcaggttccagctcagtggctcatgcctgtactttgagaggccaaggcaagattgcttgagcccaggagttcaagaccagcctgggcaacatagggagatcccatctctacaaaaaatacaaaaaaaaaaaaaaaattagctgggcatggcggtgcgtgcctgtagtcacagctactctggaggctatggtgggaggatcacttgagcccaggaggtcaaggctgtagtgagtcataatggcaccactgcactccagcctgggtgacagagcaagactgtctcaaaacaaacaccttcagaatcagttcatggatcattaccattattaacatttagatgcgttttcttgcagttgttttctatgcatgtatacatatcttttttcttttaaaagaaaattaggctgggtgcggtggctcacgcctgtaatcccagcactttgggaagccgaggtgggcagatcacctgaggtcaggagtttgagaccagcctggccaacatggtgaaacccctgtctctactaaaaatacaaaaattagccgggtatggtggccggtgcctgtaatcacagctagtcaggagcctgaggcgggagaatcgcttgaacctgggaggtggaggttgcagtgaggccagattgtgccattgcactccagcctggtcaacaaacaagagcgaaaccctgtctcagaaaaaaaaaaaattagattcatattctacatattatttttatcattttccatttaacattttatgataagcattttctatgttataaaatattttcagacataattggccacatcattttctgtcttacagttgtatcttaatttatctattcccttactattgaacatcaagattgtttgtgcctataaataattatttaacataggcctctgttcccatctttgatcatttcctctgagtacgttctgagaaatgcagttaactggtgaaggttatgaacactgaagctcgttggtgttcctgggtggaatctgatctggtggacctgctgtgagctgttcccatcggctctgacatgacgctgtgagctgttcctccctggacgaacatgttcctcccatgacgctgtcaccactccctggccagcatggggtcgttccggccttgatttttatatctgccattttgaggctttaagaatgttatttgtccctgcttgttggccgtttgtttttctcttcatatgtgtggtctgttcttgtcttttgtccactattctctttggtttatttcacacacacacatacacagagagacacacagatgcataaatgacatacacatacacacataaacagatgcataagcacagacacacacacacacatatatatccccttggcatgtacattttctgtctttgttacagcatttttaatgcccagaggttttctttttcttttttcttttcttttctttttttttttttttttatgagatggagtctccctctgttgcccaggctggagtgcagtggtgtgatctcggctcactgcaagctccgcctcccgggttcacgccattctcctgcctcagcctcccaagtagctgggactacaggcacctgccaccacgcccagctaattttttgtatttttagtagaggcggggtttcaccgtgttagccaggatggtctcgatctcctgaccttgtgatccgcctgcctcggcctgccaaagtgctgggattacaggcgtgagccaccgtgcccggccaaaaaggactcttaaaactcaacaataagaacatgaacggctgggcacagccgttcatgacacagatggctgtgtcatgggccatagaataatttaaaaaacaataaaagtctcagctgggcacagtggctcatgcctataaacacagcattttgggaggctgaggtgggaagatcacttgaggccaggagctcgagaccaacatggacaacatagcaagactccatctctaccaaaaaaacaaaaaaaattagttgggcatggtaatatgcacctgtaatcccagctgcttggagacttaggcaggaggattgcttgagcccaggagttcaagtctagtgagctatgattgtgccactgcactttagcctgggcgacagagcaagaccttgtctcaaaaaaaaaattctattttttaataaatggacctgaatattttaccgtaggtcttcccaaagggtccagggatgccatcacccgattgcatagctagaaagcggatggactttttagtaagtgtgggttctagtaagtgttgccgcactgaagaacatctctggccaggcgcggtggctcacgcctgtaatcccagcactttgggaggccaaggtgggtggatcacttgaggtcaggagttcaagaccattctggccaacatggtgaaacacttcctctactaaaagtacaaaaattagctgggcatggtggtgggtgcctgtagtcccagctacttgggaggctgaggcaggagaatcgcttgaacccaggaggtggagcttgcagtgagccgagatcatgccaccgcactccagcctgggcaacagagcaagactccgtctcgaaaaactaaaaaagaagaagaacatctctgctctcagcttaggtcctgggcccctaaagtcagcgaggcagccattgtcctagggtgatacgatgacatggatttgggactccctggaggaggccacacacacacaaaatgcaactctacaaggggagggaacagaaactgaaacaggtatctgcaatgtgcctggatccgaatttcaaaatgtgttgaagaattatggatttacaccatgagaaaagcactggttggcttttgtgcctgcttcactttggctctgagttaacttcaaacactgccaaacacaatgctagcacatggtgaccctcaaactaataatttataagatgggatccacttccccggtggaagtggccacatgctgccctctccccacccccacggcatacttgggcatgacctgcagccttttgttgccatccaggttcgtgttcattctgctggtgcagtaaatcaaccactatgacatggttttgcaaaaaagaaaagatttattcacaagggcactgatcggggaggtggatcctttttaagtccttaagtctttcgtcccccgaagataagtaacagcttccttctgtgtgagcatggctggagttcatggcatttcacaagacacgtgtacagaagagggtagcattagcattttccaaaggcggagtttttggccctccagtgtcaaaaggccacctttcgggcacttgtgcaggcccaattgaagggttggtggtctcaaccagtttgaactggacaggagctggcccaagttcctgaaaaacaactgaagaagccggcaccatggtgacttatgcatgttatctatacagtagccagggaaggttaagtttcagcattcagcggcaaggctttcagctactgtggcccttaagcttcacagaaaaaggagaaaaaaaaattaaaaaccaaatgacccaaaagcaagcagagcaggcagacctggccaaattaacccttcagtttcactttcccttgctctgttgggcatttgtggcttggaaaatggccccctcctgccgcagacagaccctttactgctgacaccaatcattacattgatctgtcgtggttcagtgcaccactgcactccagcctgggcaacagagtgagaccctgtcaaaaaggaaaggaaaggataggaaaagggaagagaagagaaaggggaaggggcaagggaaggggaaggggaaggggaaggggaggagggagggaaagaaaggaagaaaataaaagaaagaaaagagaaaagaaaagaaaaagaaaaaaagaaaagaaaagaaaatgcacagtgagttagatttggcctggaggctgtagcttgccaactcctcctctggattcatggattagagtttaaggaagagatggagaagtatggcagaagaactggagtgaggccgaaccccgtggtgttctagaagaaaggctcttgacacaagcatctggcagttatttttcaggggagaacctacaaattataaggctgtgcagctccccttactagtcaagtgattacacttttgttttcttttatttttttttagagacaggatctccctctgtcacccaggctggagtgtggtgccgcagtcacagctcactgcagcctcgaacttgtgggctcaagtgatcctgcctcagcctcctgagtagctgggactacagacacactccaccatgcctgggtaattgtttctagttttgtagagatgaggtctccttgtgttgcccagaatggtcttgaactcctcgcctcaagcaatcctcccaccttggcctcccaaagtgctgggattataggtatgaaccaccatgcccggcctcatgtgactactcctacagaggccctcgatggcctggaatgattgattccaggaccctgtcttctcatcccaaagcaccaaaccctactgacaaggaaagagcccccatttcagaacttccatggccaccccccaaccctgggattggcaactttgcaacctgggcttctccgataatcagatttacggtaagaccccaaagaggtccaggcgcttctaaaacaagttagacagagaatccaaacccaaatcctcaagatgtgagcccacatcacatcccccaaaatagagcatccgtgaccactccagccttgctagggacacagcatactccttgaccctcaccaaaggacaattgctctcacaaacacggggatccactggttcccacgcactaagcaaacttttatggccttaattgacactgtttccccagagaccccactaaatgtaagggaggaaccctctctgttccctgggacataagattgaaggcaaacaagtccgccttagcctgatcactggtgcaatagctttgcagaatattccagtggtctcagttctttctgctcttgaatttctatcactgggacagatgctccaattggaataaaacccacactttgtcccttactgttggtcttggcagatgagaccctgaggacctgcccaagccattaaaatcattaatatgacccaaaataaattaaaacagggacttcaaggattgagagaaggggtgaccatcccctctgtttctccatttaacagcccaatttgacgtgttcttcaaatggaaaagaacaaatgacatctcacagtcgatgctgaaaccttaacccagggggccatgggggccccagcccctgcagactgaaaggatggagcccattcagtcttttgctggccgatattttgctatttttgcttccttgcagtgttccacagtacctaattcaacaggctctcagcctctactcccattctatttattgtggtaaaatatataacaaaatttaccgttttaacctttttctttctttttttttttttttgaaacagggtctcactctgtcacccaggctggagtacagtggtgccattgcagatcactgcagcctcaacctcctgggttcaagtgatcctcccacctcagcctcctgagtaattaggattacaggcttaagccaccatgcccagcctactttaatcattttttaattttaattttatttatttttttaaattttactttaagttctgagattcatgtgcagaacgtgcaggtttgttacataggtatacacatgtcatagtggtttgccgcagctgtcaacccgtcatctaggttttaagccctgcatgccttaggtatttctcctaatgctgcccctcccgcagccccccatcctcagacaggccccggtgtgtgatactcccctccctgtgtccatgtgttctcattgctcaactgccacttataagtgagaacatgcagtgtttggttttctgttcctgtgttagtttgctgaaaatgatggcttccagcttcatccgtgtccctgcaaaagacatgagttcattattttttatggctgcatagtattccatggtgtatatatgccacattttctttatccagtctatcactgatgggcatttgggttggttccaagtctttgctattgtaaatagtgctgcaataaacatatgtgtacaggtgtctttacagtagaatgatttataatcctttgggtatgtacccagtaatgggatcactgggtcaaatggtatttctggttctagatccttgaggaatcgccacaatgtcttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgagaagtgtctgttcatatcctttgcccactttttgatggggttgtttttttcttgtaaatttgtttaagttccttgtagattctggatattagacctttgtcagatgggtagcttgcaaaagttttctcccattctgtaggttgcctgttcactctgatgatagtttcatttgctgtgcagaagctctttagtttgattagattccatgcgtcaattttggcttttgttgccattgcttttggtgttttagtcatgaagtctttgcccatgcttatgttctgaatggtattgcctaggttttcttctagggtttttacggtttttgggttttacatttaagtctttaatctattttgagttaatttttgtataaggtataaggaaggggtccagtttctgttttctgcttgtggctagccggttttcccagcaccattattaaacagggaatcctttttccatttcttgtttttgtcaggtttgtcaaagatcagatggttgtagatatgtggtgttatttctgaggtccctgttctgttccattggtctatatatctgtttaaaaatatggaacactttggctgggtgcggtggctcacacctgtaatcccagcactttgggaggccgaggcgggtggatcatgaggtcaggagatcaagaccatggtgaaaccccgtctctactaaaaatacaaaaaattagccgggcgtggtggcgggcgcctgtagtcccagctactcgggaggctgaggcaggagaatggcatgaccctcggaggcagagcttgcagtgagccgagattgtgctactgcactccagcctgggtgacagagcgagactccgtctcaaaataaataaataaataaataataaaaaataaaaataaaaatatggaacgcttcacacatttgcgtgtcacccttgggcagaggccatgagaaacttctatcgttctgattttagtatatgtgctgccgaagcgagcactattttaatcatttttaagtgcacggtttagtgacattaagtacattcactgccatctatttctagaatcttttcatcacccgaaactgaaactctgcattcctattaaacactaattcccatacctcccagcccgtggtaaccacggttccaccttctgtttctacagaattttttttcttttttttttttttttttgagatggagtcttgctctgtcgcccaggctggagtgcagtggcgtgatctcggctcactgcaacctctgcctcccgggttcaaacgattctcctgcctcagcctcccaagtagctgggactacaggcacacatcaccatgccctgctaatttttttgttttgttttgtttttgttcatttgttttctttgaggcaaagttttgctcgtcacccaggctggagtgcagtgccgtggcagtggcgcaatcttggttcaccgctactctgtctcccgggtccaagtgattctcttccctcagcctcccaagtagctaggattacaggcacacacgaccacatacggctaatttttgtatttttggtaaattttgtatttttggtatttttgccaggctggtgtcaaactcctgacctcaggtggttcactcacctccgcctcccaaagtgctgggattacaggcgtgaggcacctcgccccgcctgtctctacgaatttgactcctctagatactccacatacatggaactgcacagtatttgtcgctgacttctggctgtcctcacctggctatgcctactttgggggataatctgggcctgggacaccacatccccgtagcaggccccaccgggccgcacaaacagaactgcgccgaagttcccccaggctgttacccccacttgtttaggctcttcaaagatgctaccggccgggcgtggtggctcatgcctgtaatcccagcacttcggtgggccgaggtggtcagatcacttgaggtcaggagatcgagaccagcctggccaacatggtgaaaccccgtctctactaaaaatacaaaaattagtcgggcttggtggtacgcgcttgtaatcccagctactctgtaggctaaggcaggagaatcgcttgaacctgggaggcagaggttgcagtgagccaagattgcgccactgcactccagcctgggcgataaagtggatactctgtttcaaaagaaaaaaaaaaggtggcaccggcccggtgcggtggctcacacctgtaatctcagcactttcggaggctgagatggaaggatgtcttgggcccgggggatggaggctgcagtgagcggttattgagtgactgcgtccagcctgggcctcagagtgaggccgtgcctcaaaaagaagaaaaaaaaaaaaaaaaaaagcagcagctacccatccagccgccagatggcagcacgattccatggcccccactagccgctggctgcctggtgccggatgcagtccgaaaggcggttctgagctccaagggccggcgccgcgcgtgcctgcggtcccagctgctcgggaggcccaggcaggagaatcgcgtgaccgggagttctgcgctgcagtgcgctgtgccgatccaggtcctcactgaagccggcatcagtatggtggcctctgccaccaggccgcctagggaggggcgaggcagccccagttggaaacggagcgcgtcagtagtggcatcgcgcctgggaatagcctctgcgctccagccgggtcgacctgccgagactccgcctctaaaaccagcaaataccgggaggctgagggacgaggaccgctggagcccgggaggcggaggttgcagtgagtagctgggattacaggcaggcgccaccacgcccgggtaatttttgtgttattagtagagacggggttccaccatgttgaccaggcaggtcttgaactcctgacctcaagtgatccaccctccttggcctcccaaagtgctgggattacaggcgtgagccattgcgcctggccaaataagtaatttaagcaattttttttgtttcagaaaaaaaattaactcataaaggagcccccccgacacacacacacacacacacacacacacacacacacacacacacacgggaagcagcagtgtaattggaatgcccactgctgaggctctcgaatgagtgtcatgtgtgcacattttgcccctcacaatgcacgtcagactattaataggaagcagccgctggaatacctctggtggggtgtgtgcagcaggcagctttggaattacggtatccccaatgtgacagcaggacaatggcttcttcactggcactgtccaaccacagtgctgtggttatgtctcgaggtccattattgggcgaaggtcactgcagactcagggaggcccaggagctcaccccaaccagcttctttaccaggtgagtgacctcagccctgcagctggactcatggagacaatgacctcacccgaagatagatgacccctgtccaccgtccacacaacaactgaactggccccaggttgactcctctacaccctgcttcctactgtacccctgtcaaaggccttcctcccacccttcccactcctcttcctccctggcagcccaaccaccacaaattcactaacttgttttcaactcttacaggctgccctcctaaccctagccctgacctctgccctcctaaccccagccctgaccccaccgccctctcaggaggctttaccaatcctctgcatgttagccccacccaaggaacaggcctattttcaagcatactaactgttgggtgtgtcgcttacctatgcatatgacagccaatccaacctacctaaatgacagcacagctccatccatggatgtggctgatcacatctccaaaccatcttcccactggggacaaattcttggattttttagagacaggttctcactctgtcacccaggctggagtacagtggtgagcctcagactcctgggctcaagggatcctcccacctcaacctctggagtagctgggactacaggtgcacaccaccaccgtgcctggctaaatttttaatttttttttttttttttttttttttagagatgggggttgctatgttttccaggctggttttgaactcctatcctcaagtgatcctcccacctcagcctcccaaagcactgggattatagatgtgagccaccaatcttagcccaaatttttaactaaactcaattaaacaaatgaacaaacagaaaagactctcaaaccacacactgtcgtctctcacccaacagagacaagacgtctataaaccaccaatctgtttaaagagaccaccaaatgttcagaccatgaaactgaaagaatcaaaataaagttgtcactatgccaccaacggacaaaagccaggagcacacaaccaggggtcatactcactgaaggtcccccaccctgatggccagtcaggggcggcttgcgggtctcagagagggctcaccacctgcttgcagtcattggggatgggaaggtaagtccaacccatgccaggtcaaggcacaaagactgtggggggaatgcaccagacacataaagagatgactttattcaggctactgctatgggaagaaaactcactaatgaggaaggaggggcctggtaaataagagactcatgtggaaggctggaggcggggtcttagaatggacaagggcaaagtgctccttctggtctcactatttctcagaacgcaaaggaagaggcaatttctcagtgagcaccatttccctggaacccagggctgagatgaatttcagtactgccagcggcctccgcgttctcctgtgtgtgtaggagtttgtgtgttccagtgtgcgtgttcccactgtgtcttggtgtttctgtgtgcctggtggcatgtctgtgtgtgtatctgcagggtgaaagaccacagatactatccgaattcccgtgctcaagtgcgcctcctgccttggctttcctgagtgtggggatgacaggcgtgagccaccacgctgggcctcatgatctgtttctagtgcagtgagtgcatcttagggtgggtgcccgcctccatgcttagtagggcatggatgctgtgtatgccatctgtcggtaggatggttacacttctgtgtgttggctgatgtgtgtgtctcagtatttagtcggctctggtggcacatgtgtgtgttgcaggttgtataagttgctgtttctctgtgtctggtggaaggtgtctatggttgcagagtgagggtctcttggtgtttctgtgtgtcagagggtgtgtgtgtgtgtgtgtgtgtgtgttttgcaggatgaggtgtgttctgtgagtgtgatgtggggggtgcagggtgcatatctgtgtctacatttcttttttttcttcttcttcttttttttgagacagagtctcgctctgtcgcccaggctggagcgcagtgatgcgatctccactcactgcaaacactgcctcccaggtttaagcaattctcccagctcagcctcccaagtagctgagattacaggcgcatgccaccacgcccggctaattttttgtatttttagtagagatgcggtctcaccatgttggccaggctggtcttaaactcctgatctcaagtgatctgcctgcctcggcctcccaaagtgctgggattaacaggcgtgagtcactgcacccagcctgtctgcatttctgtctggtggtgagctatgtgctgcaggtagtgtgtttaatgtgtttctctcatgtttccgtgtatctggtggaagatgtgtgtctgcaggatgagtgtctcttttgtcggtgtatcatggattgtgtgtttgtgtgtgttgcagggaatgtgtttgtctcagtatctgagtgtgtcgggtcgtgtgcaggtgtgtgtttttttgtgtgtttgtttgtttgaaacagagtctcactctgtcgccaggctggagtgcagtggtgtgatctcagctcacctgcaacctccgcctcccgggttcaatcgattcttctgcctcagcctcctgagtggctgggattacaggcgtctgccaccacacccagctaattttttgtatttttagtggagacagggtttcaccatgttggccaggctagtcttgaactcctgatctcaagtgaaccgcctgcctcgtcctcccaaagtgctagaattacaggcgtgagccaccgtacccggccgcacgtgtattttgtatgatatatatctgcttctgactttggtgaagtgtgtgtgtcgcagggttgtgtctatcttgtggtttctatgtggcctatggtgtgtgtgctgcaatgagtctctgtcttggtgtttctgtgtctggtgatacatgttgtatgttgcagagtgagtctttttttccatttttatgtgcgtggtgtgggttgagtgtcctccatagtagtgggctggctgtgtgtgtgtcacagcgcgtctgtctctgtgagcggtgggttgtgtgtgtgtgttggagagtgagtgtttctgtctgatggagtgtcgtgtgtgtgtgtgtgttggcaggtgagtggctgtgttcctctgggcccagtgctgtgtgggcgtctgttgcagtgtgtgtgccgtctctgtgtttctgagattctgctggctttgtgtgtgcatgtctgcgtttcgggctgtgtgtctgtgttggtgtttctgagtctagaggagcgtgcatgcggcgtagggttagtgtctgcaggcctctgtgtgctgtggcctgcgtctgcttgtaaccaccaggctgggcctggtccccacattcctcccactccattgtgctctgtgctacaaaaaatatttgcgttttccaccactcataatttttcctcctcaatcgctaccagatgtgggtcctgtggtccccatccccatggcaacggaggttccagcagccgcggttcccttttgtggcgcctgccctgggagctggcactgctgtgagccccgagggggtggggagaagcgggtggtgggaggcaggaggctggaggggtcccagcagctcccttcccagcagccactggaaccctcctggggggaagggaaggctggtggtaggttggggggggtcccctgttttgtgaggcacccacaggtagagtcttcgacacctagggggcttcccagagaagggcaaggagaggtccccagaaaggcctggtcactgggacatccctgttctctccaaatcgtgctggtccaggctgggggaggagaaatagcaagagctgagggcttgggggttcagggaacagcagtgtggcatcctcatcgttctggggggtgggcaccgcctagacaagaatgtggtctgagcccctgcactgcccacccctcacccacacgcaggcactgccctgccctcgcggagcccggctgggcatctgccctcttggccttaaccccagcagcccgcatggcgcagtgcccaaacagagcagaggctttccagccacagggccatggctgggagggtgcccagctggctccagggaagcagtatggcccagaggcagggatcccacattccacgtgctgcctgtttgtgtcctgccagctgctctggacggccgacccagggcaggacgcagtctccactcagatggctgggccttctgagatgggtgacccctctaagatgggtgaccaaagttgacctccgtggggcatctggtcagaggatgagagtgtgcccaggacgagagccccaagttgccagcgtgagaccaatgagtgctgtgtggcggctgcagggtgatcagaagatcctggcagcaggggaagactttgagctgggcatcaaaagatgagatgcaggagaacaagaagaggcctgccgggcagaggcaggaggtgggaggagaacagacaggcaggagctgggggaacttagtgtggggacagcaggggccatggaaggtgagggtctgcggcttaggagggtcacttaggaggcctgcccgggagggtaggcgggtcaggagcagcgaggccgtagggcacagatggtcacagatagccaggcagccgggtctggcttgggggcaggggatctgccccgggcgctccctccgtctccctcaaccttccgcagtagcaggcggggctggcaggcaggagagtttccggctgaggacaaggaacccgttgaggcagacagcagggctctgtgcagcaggagaccggcttgtttgtgctggaggaggcccggctggagtaagcgcccgcggccccctggccgcagcctctgcaccccccgcaagctgccaccaacagctctgaggcccaagtttaacagcagcggccaggggaaaaggccgggatccgaggcaggcccatcgcctgtccctttcagtcagggactctgcctgatctgcccccacccaaccttcctccccgtgaccagtccagaatggggcaggccagatcggggccgcataaacttgataaacaaacgaagcctgtgggttgacacagcccacttccaccatggtcccgggagacccacgcctgggctccagggctccccgctgagataaggggtgggggagagtgcaggacaggtcgtcacataaagttacttctggggggcatctttggccgaagcctgcaaacaggaagtgatcagagcatgaggggaaaggcattttattaagaaagctttggccaagcccccgccgggaggagcccatcctggggcaccggccgaggggggagcagccctgctgggggcctataaatacatctcctcaggccactagagtcgcccctggaggtcccgcggcgtgtggggcagtgggaggccatcaaaaccagctgacagctgaggggcctgggcccggggcgccagggaagggaaggggtgggacggactaagcccctgaggagcggagaccagccctcctccccaggctggggtcaaccagatgcccgggagcctggccagtggaagtagccccgggctctattgggacggccaagggagggagcctccagccagaggcaccaggccctagcgggggagaggcagcccgggcagaagtgcctctggctgcaaccaatgagaaggtagccctaaccaagtccactcctggccagtaagaggcggtctttaagcggaaccctcccatctttggccaatgagacgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccgctggtgcctctggcaagggaagagcagggcggtcacagccttcaggaatacctttaggggctccaacctccaggcgcaaaccttcacctttcctcctctacccacgcccttggcactgtgtcaccctggcatctagacgtgcctggcacagagcaccaaccacacatgtgtacttcagagcctcaggctatgcggctgactctgaactcaggctgtgcaaggagtgatgggcgcattcccgcgactgaagcccaaccttggcctggcctggcagccctgccccaacacccctccagccttgggcgcctgcatcatcgaatttgaggctggaacatccccacaggggttccattatccttctttaagagagaaggcttctagctgggcgtggtggctcacgcctgtaatcccagcactttgggaggctgcggtcacctgaggtcaggagtttgagaccagcctggccaatatggtgaaaccctgtctctactaaaaatacaaaaattagctgggcgtggtcgtgggcgcctgtaatcccagctactcgggaggctgaggcaggagaattgcttgaacccaggaggcagaggttgcagtgactggagatcatgccactgcactccagcctgggtgacagaggcagactccgtctcaaaaaaaaaaaaagagcgataaggcttctgaggctctgagttggtcacctgcccgtggcatctgggggcacagtcaagggaggagacagggcagaatcccagaccatcaggctcctttctgctatctgtggatcaaaggctgtgtgtggatccaactcccatactctgtggatcccttcctcctgtctcctctgccaccccctacctaagcccagaaacttctctctgcctactttcccccaggagcaaccctgggctgtggcctacccatctccccacacctgtctccggtactgagcagcagagtccagctctatggcctcagctctgtgggcaaccctcaggtaccagcatggccaaggccttcctctccatgctgcctgcccttctcctgtgtcccacccagaacacagcttttccatgggaacatttcactgggctggagtgatgcccaggtagggccttacttaccctcatggggtacacagtacacagggccttcatcagtggtgtcaaacgaggagaaggaggcccgagaggaccaggatggtgagggctgctccagccctgagggtggctccaggaagctgcagttgagtgtgttatccaggtcgtggtgggccactggggaaggatgaggcagagctgccaggggtccactctgccccagccggtgccctcattagcccctgctgtgacaaatgttgatggggtgaccaagaccagccctattcttggactgcagggggcacaggcaactcaacaggtacagtgacactgggccaggactggagaatgggtagaggtgaacccagaaaagaaacatgggcacaacatgtgttaaggtgcaaggcaagtgtgtgcatccagggagctggaaaaggttgggctgacgtgttgagaaaaggccagaaaggtgggagacggggctgaagaagacacctggctgggacaggccaccaaggcctccaagctctgttttaggccctgccttgtgcgaataaggaagccttggagcacttctgagcccaaatgcgcagtggcagggctgccctttggctcagcccatctcagcaagctgcaccctaggcctggcctccagagatgcagaccccacaacagggggccccagaagctggctagcctggcctccattccacagagggatgtggggtccactccccacacctatgtccccagatgccatgctgctaggtgggccaaggggttttctctctcttgcttgcttgctttttcttttctttcgacagttttggggtttctcctccctccctccctccctccctcccttccttctctttcttcttttctcttctcttctcttctcctctcctctcctctcttctcttctcttttttcttgacagttttgctcttgttgcccaggctggagtgcaatggtgcgatctcggctcactgcaacctctgcctccctgcaacctctgcctcccaggttcaagtgattctcttgcctcagcctccagagtagctgggattataggcatgcgccaccacacccggctactttcgtatttttagtagagaccgggtttctccatgttggtcaggctggtcttgaactccaggcctcaggtgatccacctgcctcggcctcccaaagtgctgagattacaggcatgagccaccatgcccggcttggctaaggggttttctcagctgtttccttcatctcccaagagtctgagcccccttcccctccatctttagaaataagtgggaaagagaggaagagagggtccacccaggtgcaagtcagcatggagagaagcggcacaccccacccccctatcctgttggtgggtggggaccagcctgcccactttccaggaggatctctgggtactgctggggatgtaggcaggagggtgggtcctctccgtggggcagggcactcccgtggccacgcattcccccagcagctctggccgggatatacagcattctcctacagactgggggagcctgcgggacccagatgtccacacacccctgatgcgatcactctcagggccaacgtttctgacatatgcccacatcagccggcgcacctaggactcctgccttcctaccttgcctcgccctcagcagctgccacacctcttaccttccctctggtcgcacctcctcgcgcccacgcacatcaacactcaaggtcccccatttcctcactgagatctggaccccctcacacccatttcccagcagcttcctgcgtcgagaggtgtttctcccagataccccgcgctgtcatccttacctacgactttgggtagtttctgcctccggagcgggatccggggcagcttcatgctgatgcgactgaagcgcccgcatagtcggtgcggcgccttcttcctcccaagcgaaagctccctgcgggggcggggtctgagcggaggggcggggccggggcggggcccaggggcgattagatctcggccggagccaagcacagaaggggcggggccacgtccggggcaggggcgcggaagggttggatctgggtccggtggcacccagagggtgcggcctgaacccaggcgaaagcggggcagtatctgggctcaccggcgcgtagggtccttgccgcggcaagcgcagcagcagccgagcagcgagagcagcaggcagacgagcaggacgagcagcgcgcccgcgcccatcacgcccttgcgctggttggtttctgtagggggttatggggtcagcgcggtttctggcaccccctgcattccttaacgggacgcccctcatccacttacctaggtggcaggcaccagtgaccgggtcgcacgtgtcctcgtggcagctgcaggcctgagcacagtccgcgccgtggagtccgggcgggcacgtcacgttacagctgccgggacatagggtcaaggcatgccacagccgcccccctaggatgccccctaccctcacccctcacccgcggccagggcccagggtccagggtcccagaaccgggctctctctcgctgcattcgtcgtctagggattgaagccccgccccgcccgtggcacatattgggtagtggatgttttggaaacgaatgttgcacaacactagtgggggggcctgggggataggacccgtggtggccgcgccgcagcgcccactgctggggctgactcggctaggtgggaagaggggctgctgaaccagacccttggctgtaagtggaggtccctggtccttctgtaccaactcggggtcaccttaagagcccactgacacaggctggactggtcaccagatcctgcgctgaacgtgagctccccgacatccaggcaggaaactgcccccaaagagcctactgtcactccctagctggggtaagggaccaaggctgaggtgataacccagctcagggtggagaggccacctcgtcggctggacccccctctgtggcaggtacaagcccccaaccccctcccggtcccggggcactcactggggcccgtggacgccagggctgcacaggcagcgccccgactggaagtcgcagtgtccgctgccgcagtcggcgcacacgaaggcgcagtcctcgccgtaagtgccattgctacacttggtctcgcaccttggaaagaggggaggaggcgtcagcagaaatggaggcaaacggaccacagcgccctcgacattggggcctttgttagggaggcagggcgggggactgcgtgtctgggccgacgcaggcagggctgctcaccggtcgccgatccagcccgcgttgcagcgcgtacacttgccggtgacatggttacaggcatgcccgtcgcggcatggcggacagcggtggctgcagccctcgccatagaaaccggtggcgcaaggctggtcgcacttggttccgttccagccgggctcgcacgtcaagcagcggccctcggccaccgtgcacggctgctggcccttgcactggccacacctgggggaggggtcggaggctagggaaggctgggacccgcctcacccctgtccccatcggcggcccgcccttccacctcctccctccctggccgagagaccgcgcttaccggcggcgacagcccaagccgtagaagccggcggggcacggctcgcgacagtacttgccgcggtagcccggctcgcaggcacacgtgccgtccacagggtggcagcggccgcggaagcactggcagtagcgatcgcagcgcgcgccgaacgtacgctcgcggcactgacagcggccgctctgctgctcgcagggagacgagttgcaggcgcactggttgttgcagctgcggccccaccagcctgcgtggcacaggcaggcgccggtctgtgggtcgcagcgcgacgtggcgctgcagtagcacgcgctggcgcactgcgcgccccaccagccgggctcacagcggcacgcgccgctccgcgggtggcacgtgccgtgctggcactggcacgcatgctcgcagcgcgcgccccagcgccgcgcgtgacaagtacactggcctgtcacgtcctcgcactgcccgtgtgggtggcagctacacagctccttgcagtcggggccccagaactggcgcgggcactctgcaggggaggagcggagggggtggaaggccccggtgcttgagtaggtgcccccagccagccggaacctgcccgcgtcccgcactccagccgccacctctggggacccgccccgaaggcggatccgaccccgccccaccttggaccccgccccatctctccaggattccgccccaccgaccaataccggcccgaccccacgctcactggtgtcgcagttggcaccgaagtagccgtggcggcagcggcactcgccaggcctcacgcacacctcgttctctgagcacgtggagttgccttcgcacaccgctgtggacgagacaggccagagctgctgcgcgtcctagccccgccccctcccccgccccaggtccccgggatgacccactcaccaatcccacactcgtccccttgctgcctccagccagcgcagcacgtgggcacctgggagctgcgagcagagggaggacatctaagcccgatgcccctcccccagcccccatctgctccgggctcctccgcagcctccgcacagcctccctgcctctgcagttgcgctcctgtcctaggggggtggttaatgaggtcctgccaggcagtcgtctggcggtggaggattgccacaaacagacctcaccgccaagaactttccagcccagaaccacccaccccatctcacctaactcctttgtgtcctcctcccacagccattaggcctgagaaaagtggccttggagtcccaggaaggacagcagtgaggcagcagccagggagaagaccatgggcctcaggacctgcccaaatgtgagggtctagggcatccctccaagtggagggcccagcctaatgggtgtcatggatccagatgtcatgtgatgtgacatgatgaggacggcactaggactagctgggccacagggacacacctagatgcccagttggggttgagctccagtggggaggggcagcctctggacagggggacggggggtggcatgtagacacagtgaggtgaccacttggcagaggggcttctggagggaggtggggtgaggcccacccagccactagggaaggagcaggcacatggggagtcctccacgtgcaggaggaaagtcaaactgtggcaaaagggctcagggaccagggtggaggaaggagctattagagcatctgtttatgcctttgttgttggttttgaaacagtctcgctctgttgcccaggctggagtgcagtggcacgatctcggctcactgcaacttccacctcccaggttcaagcaattctcctgcctcaaacctctcaagtagctggaattacaggcacgtgccaccacacatggctaatttttgtatttttactagagacagggtttcgccatgttggccaggctggtcttgaactctgacctcaggtgatccgcccgcctcggcctcccaaagtgctgggattacaggcatgagccagcgtgcccggcctgtttatgctgattgtcttccacttgttccatttgatttggctttacagagtacacaatgctaccgcagcacttcaggagagcacaacctctaaaaccctgggtggatggggtgtgtgagcacaaaggtttggaggccctgcctgagtgaagccatgatggctagagagggttcgtaggggatgagctggggttagcccacattcaggggcagaggaggctgagaaggaagagccaccaaggctgcgggatcctaggttcccagccgacccagaacttcgcctcgatcctaaaggcatgtaacagccattcgcactttagagaaaaggagcacgcttcttcacaagcaggcttggattcagtatctgaatctagaaccggaaggtggtggggggcggagtttgggaggaagcctgaagaccctagcgggatgggatagactggccctacaccatgcatttcaggatagtacatgcctggcatgctcctgcccaggcttccgaggatgccccagccattccccagctagacagaataccaccccttgtacagagcacctaggcctcgaggcccctcctcctgaacaaggcttggttctccttcaggccaaagatgggacctggcgaacaggaccataaaatctcaaactttggggaattggtccagtgtattttccacaataaaactggaaaccagagacaggaatacaaaggcctggcttttcctggcccctgcccccactgtctccacccacccagccctgacccagggggcaccaaggtgcccatctgcagggagacccaggtctgctggccatcacccacccacttgtgtctgcttctgaaccatgttcactggatggagagcctctgcaggtgtccctcctgtggggagctttgccaggtggcctgctggaattgccccggaagcactaacccccttctgccctggacataaggctctgtggctaggaccctcgttttagggccacactcagctgggtttgatgtctgggtttgccacttgctgtgtgacctcaggcatgcagcttaagctctttgagcttcaggctccttagctatatagtagggctctactgtagaaagattaagagagccaagatgtttttttgccgggcgtgctggcatgtacctataatcccagctactcaggaagctgaggcaagaggattgcttgagcccaaggagtttgaggctgcagtgagctgtgatggcaccactgctctccagcctgggcaacagagtgaaaccctgtctcaaaaagagagatagagataggagagagagagagacagagaaagacgacagagagaaagagagcgcgcgccaagacctatgaagtggtttggcacatactaagcacaaaggatcctgagcacaggctgcagtgcctctgagtgcactcggtcatctctggtttagcgggcacccaggcctaaccccagcagagctaatgcccaccagcaggacagagtccatttgggttcactgagaacaagatgctttccttcttggaagggctggcagaaaaggccgggtggtggtggcaagcccactctctgaagatcttacaaagacgggtggggaaagatggcctgctgcagggctgctcccacgcttgccctgtaagtcggcaagaccctcagaagccaggccataggctgggcccaggcccctcagcaagcaagacatgccgtaggcttctccctcgtagagcattagttctgtgattcaaacccactgtgagttcttacatcttcaagttggctcatggggtccatacctgtccatgttctcccccaaatccaggcagaaaagcttctctgcctgccacacccttcagaccccacaccagcccgaccctcctgctgccccgcctggacacctctcctctggtttctgtccccatcctcagatctctcttgtgtccacactagctccctcgggaagctcactgaacactgacaacaccttggaccctccagcagggctctccccatcaatgctagacttgcaaatccaactgcccaatagatgatgtcaccagaaggagacctcatgggcctcatgcccaaccagcccaaacctgaactcttgacctccttgcaccctgagtcttccctgcctcagataaccctgcctgtcctttcaggctgggaagctgagacctggagaagcatctctgactcttctttcttgtctacaccagatccattgagaaaaaagacgctgagctctagcttctaaacgatatctaaaatgggatcacttcctccttccctatcccagccttgtgagagccaccctccatctccctggctttttgtaactggccccagcttccaccccctgccccccagggtgcgaagtgtttgccacctggcagccaatcctggtcagatcccaccctttctctgtacaaagcccccagggggtcccatggccctcagaagaaaagcccaagtcttctgagcagtggcagcccacggtggcctgcccaccctcactctctggcagctcctccgccagcccctcctggactctgcccagcctcctggatccttcctgtacttccacaggccctctgccttgggaaccttgccccagacacccacagggcctccgtgctcttctgcaggcctgtgctcactcaccaccttctcagccgttctcctcagaacaccctaaaggaaacagcactccccaacccaacacctcccagctcttgctagatgtctagacacacttgcttttctggactgtgtctcctctgccacagggtcagggtctccactgcagcttccctacaccaatacaggcctggcacagtgtaggtgcataggattttactggctttgcactctcctctccccatcctcctgcctcccaggaaagggaagggctgatggaagccttgcaagatgtgggaggacaacaaagacatgacccagaccccaggtgggcagtgcccagagtggctgtccttcccatcgacccttgccactcatgaccacagcgatctccacttagccccatgagggggttgtgatcactatcccattttacagaggtggagacaggcccagagaggtcaaatgacttgcccaggtccacacagctgggtagggtggcaccaggatgggaacccaaacccaggctcggttcctggagcaggcgcctcctgggaggtctgcagaccaggggagcgggagcaaagggctctcaggctccggacagctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagtgctggggtgtgcggtcagctccccctgcgcactcctgcgcactcagagctcgcaaggggcggaccgagcaggatgcttgaggcctgtggtagactcggtccggaccagaggcctgggggaaggggtctccgtagggacggatgggagagatacagaggaagtagaatggccaggctgtggactgcggtaggaagtagaggtaaagacagaaggagacccccgggatggaaaccctgcagtcctagttgaggagtgaagggggctgggggagcctgggcggtggattctgctggctgtcggatttccaggagaggctggggctagagagtgggaactcctgcatcaggtaaggtgggtaacagcacagagcagaaggaaggtgtgggaagggagcaagacagagggacaggccctagggagccagcggggaagctggacttggactgggaggcagcagggtgcgggtccccggggggcaactggggcagaccgactctggaagttgggcagggagcacaaatgtcccgtgtgtagccaggtcctagtgaggatgtttgtcttttggggacttgagagctggcagaaggcctaagcagggagcgggcacctccgttctttggggagcaggccacatgcggcccacaggctcactgagggagggcaggcagactctgtccaggtgtggccagatagccccgaagggtggggctggaggagggggcttggaggaggagccactgaaaggcccaaggccatgggcatcaccaggctggcacaggcagagagtgggatggggaggagcaggcccctcactcagccatgctggtgcaggagggaggtggggtgggctgaaagagaagtggaactagtgtggacacgaatgcaactacctggggacaaataaacaggccaaccacttctgggcagctcagcctgggcacagccctgacctcagcaatgccctcccagtgctggggcccctcccacggaggatccggattgcggctcccaatagaggccagcagaggtcccagtggctgcaaggtctgtcccagcccagctcctggctttagaggcactgaccccctgggctggaggggacactcacctcagctggatggaggtcatgaataggcatatcaaattccatcacctttctccttcccccagacctgtccagggagggcaccacctggatggtgccccccaatcccccaggacctcctaaatgtcttagatctctgcccacccctgtctgccacccagagtagtctttttaatctcacatgtggctatccaccactgctctcaggatgaggaccatccccagtctcacctcacgacccggtacatacatcccttgcagtagatggcaactttgggtgtcatgggcagagccctcatttctcccaaccaccactgcacccctaggggaagactgagaagtatgggaggaatgaaggatcatccacatggcactaggatgtagaaggaacccacagacaattgaccaccacgcaggcaaactgctggagcccggagccctggcctgctggttttggccaggatggctgccagaaggaagtggactttgaaggctgaggagggttttgcatgaaagcagggaccaagagcctagccacactggagagcacaagttgggctgcctcagctccggggtatcaggtgtaacccttagaaacccagcttagccccaaggctgacagtggcagggccaggctgcgcccaactccaaggcactctccacccctccccaggctgtgcaggacctcagtgagcccttcctgcccctgcagaccagaggcctcctgcaaacctgtggctgtggctggtggctcaggtgagatgttgccagccagcatgttgtcaggacgcactggagagtggtggggcatgtctggtgctcctcctttccagaaacctctgaggtctgcaggagctattgccctggcctgccaggtggtagcagagacacaggaagtgctgggtctgagacccacagagtggggttcctactctgaacccatgctcttgcgcctcaccctcaggagaaagggagatgacactggagtgtatagccatcccgccccactagggctcaacactgggtctgccaccccaaggcaatgtcatgtttcctcaggggtactcagggcccaggacagtgaggaaggtcttcaggttacacacacacccacataccacagccctgggggcacaggccaactctgagggctttgtctctaccctcaagaatccttggggtatccatttaggagagcccagagtgactgatagtcccccgtccccatcccctctcctcccatcaaggagcacacactgcccccttctcttccgggacaggatgccagcaggaacacatggctgtccccatgctctgcccagtcaactgggaaaggatggggccttggcaagttacagccctgtctgcgggatggctctgggcacaaggctcatagtaggagtctgcaggtgcagaccctatgagggcatcaggatggaagaaagcttcgtgtggtgcagccctgcagtgaggctggtgtgggctcacagcccatccatgcagggtgcaggctaagcctggcagtctcaagagggcaagaaaagcatggggacaggtgaacaggggagggtcccagctgctgtgccagtgtggtccttgagactgggtgcctaagggttacctggcaaacctgtagcacatgcagctcccctccccagcacactcagcttcaggaggttgggaggagccgggcacaggccagaggggccccccccaccgaccccctgatgctgccccgctcccaggtgctgaagctctggttccctgaccctcaggctgagagactcctaacgagctgggctgaaactctgcgtgctgccctggttgggagacaagttccacaccagagaagacactcaagtggctgcacaaccacctgtcaccagaccagggcgagttccagctttcccactgagtgccctgttagcttgtggagtttactgtgcttccctctcaggcagggtcttcccagtgccacttggcttctggcctgggcttccacagcctctcccagatggcagctctgaccccagaagccacgcttcctggggacgcagcttgggtgcactgtggaaaggaactgaggctgtggctacagaaaaacagttaacaccttctgtaagatgctttatttcattgaccaacaacatggggtctgaaaacccagcgggaggggtctttttatcacagagccagtcccaggcgagctgatgcatctctgctcctctgcccctcaggagctctcatcctccaaccccagctgcccccacagccccaccccattcacagaaagagggctaccacgtgcctcagcccccctgcccaggctgccagctcccaggtccttttggagaaggactgatctaggcagggaggagagaaggccaacccctccagggctcactgaggaaggccaaagcctttcagaagcagttcctgcagtgacgtaatccacagcctgggatctgcatggccctgagatgcctgcggcaggctggccaaggggctggtgtgaagaaagagggcagggcccataagctgtggccaacaggggcaggggccctgcctggagtaaagtgctctggcctaggctgcgtgggtttcactgccctgcagccccagcctcccttccctctgatgccaggcacagggagcctagtcctcactggagttgtcaaactcctcccagtcagacacactcatcacctcagaggcaaagtccgggtcggcctggctgcggtcaggggtcccgcggggcggctcaaggagcagggagcggggcagggtgagcacacaggccgccaggcctgagatggagttgtccagctggggcccttcctcccagcagtccttctccacatcgtaaatgtgcacgtagcctgtgcggctgccgcggttgtgtgagcggccacctaacacatagatcctgttgtccagcacagcaatgccaggctcaccgtgcccagcagggagtgggcagacagatgaccactgtccagacgtgcagctgtagcaggccacctgcaaagccaaggctagaataaagcccagcacccactgggacgaggctgccagctcccccacaagcccactgaccaaggtggcaacagttacccaccattctgacaggtcaggccccctggaaggatggcacagggccagtgttgaaacatcctgtccatgggccaggctgctgctttctcacccagggatggccgagtctgcaggaggctgtcttttgggccctcccctagaatgatcctattctctctggctttgctccagcccagcccttcctctaggccacccggccctaagccagtctctgcccccgagtgtgtggctgtgcccccatcagcatgtggtcattccccatgtctgagggcactgcttctctcccctccaggaaacgaagctgcctgagagacatggactccactgaaatgtcttcaacctccttctgcagcactcaacacaggcagtaggacagggggaggagacagaaagtggaagtaattccttgcggagtagtcaacatcaatattctcttgtcttcaaaattgtccaaacagtaaacaaagacatggaaaaatgttcaacctactagtaattcaagaaacgcaaaatcaaaacatcagagacaaatttttcaactagcaaccactgcagagaaggaaaatcacaaaacccaatgctgttgagggtgtggtaaagccatactactatgtatctgtctgacatgccagaaaaggaatttggcaataagtattaagagccataaaaatcttaccttcttgactgattagccgtttttggttctctagctatggtgggcagaatagtggcccccaaagatgtctagttcctaatctccagaatatgctaccttaagcagccaaaggggctttgcagataggatcaagggtacaagaatacaaaaaaaaaaaggattaagggtgcagaccctgagatggggcagttttcctggattttccaggtgatccatccaattgcatgagcccttaaaagtggaaggggagaggccgggcgtggtggctcacgcctgtaatcccagcactttgggaggccaaggcgggctgatcacaaggtcaagagatcaagaccatcctggccaacatggtgaaacctcgtctctactaaaaatacaaaaatcagctgggcatggtggcacatgcctgtaaccccagctactcgggaggctgaggcaggagaatcacttgaacccaggaggcaaagggtgcagtgagccaagagcaccactgcactccagcctggcgacagagcgagactctgtctcaaacaaacaaacaaaaaaagtggaaggggaggccgggggtggtggctcacgcctgtaatcctagcactttgggaggctgaggtgcgtggatcacctgaggtcaggagtttgagaccagcctggccgacatggcaaaaccccgtctctactaaaaatagaaaaattagctaggtgtggtggcgaacacctgtagtcctcctagctactccggaggctgaagcaggagaatcgcttaaacccaggaggcagaggttgcagtgagctgagactgcaccagtgccccccagcctgggtgacaaagcaagactccatctcataaaaaaaaaaaaaagaaaaaaaggaagggtaaagccagacaagagagctgagaagtgaggaggactcaacctgccattgctggctttgaagacgaagtgtccccaagccaggaaaagtggggacctctagaagccaagaaggccctcaactgacagctagcaaggaaatgggactgcaactgccagggactgaattcttctaaccagagtgagcagggaggcagatccccactagggtctccacaaaggaaagatgccctgaccgcaccctggttttagcctggcaaggcccatgtcagaggacttatgaatgcagaataaatttatcttaagttgctatgtttgtggtgataggttactgaagcaatagaaaactaatgtgctggcccagaggatctcacaagcagaggacctgttaaaagccagatcgccaagacccaccctcagggcttccgaatcagtgggtctgaggtgcctcgtaacacagcgttcccaggtgatgcagactctgttagtctgagaatcacactttgagaactgttgcatgaacctaaggaaataatccaaaatacctgaaaagctcaacaaagcaactattacttgtcatgttatttggaatagttaaaacttagacacaagaggggatgatgaagattgagtgttaatctggaaaatgcccaggacaaaagtcactgagagaagcagaatgggatatgggatgctcttttttgtttgtttgtttgtttgtttgagacaaggtctcgctctgttgcccaggctggagtgcagtggcaccatcacggttcactgcagcctcaacctcctgggctcagttgattctccctcagcctcccaagtagctgggaccacaggtgcaagccaccatgcctggctaatttttttttgtatttttagtagagatggagtttcaccatgttgcccaggctggtatcagttcctggactcaagccatccacctgccttggcttcccaaaatgcagggattacgggtgtgagccactgtgcccagctcagaatgggatgctctttgactacaatcaggcagaaaacatacacggtcaatgctgaaaatggtcatactgaaaaacagtactgcaggggcctgattatgaatgcttttcctcacccttctctattttttttttttttttgagatggagtcttgctctgttgcccaggctggagtgcagtcgtgtgatctcagctcactgcaacctctgcctcccgggttccagcgattctcctgcctcagtcttcccaagtaactgggattacaggcgcccatcaccgcacctggctaatttttgtatttttagtagagatggagtttcaccatcttggccaagctggtcttgaactcctgacctcgtgatccacctgcctcaacctcccaaagtgctgggattacaggcgtgagccaccgcgcccggccacccatctctattttttaaagttccggcaatgtggttatattaactttataataaaagttttgttctgttgttttgttttattttgttttgaatagagacagggtctcattctgtcacctaggctggggaacagcggtgtgatcatagctcagtgaagcctccaactctgggctgaaacaatcctcccacttcagcctcctgagtagctgggactacaggtatgtgctgccagcctggatctaaaagttttgttgttgtttttttttgttttttttgagacaaggcctggctctgtcgcccaggctggagtgcagtggcgtgatctcagcttactgaaacctctgcctcctgggctcaagccatcccccaacctcagcctcccaagtagctgagagtacaggcatgcaaccacacctggctaatttttgtatttttgtagagatggggttttgccatgatgcccaggctggtctcaagctcctgagctcaagtgatcctctcgccttggcttcccaaactgcttggattacaggcatgtgccaccacatccggcctaaaagtttttaagagtaataagcaaaggtagatgtgtatgtgtgtgatactgtcatggtgacatttgtccaaacctatagaatgtgccaagagtgaacactgtggactctggttgatggtgatgcatcaatgcagtttcaacaactgtgacacatccacccctctggagcgagaggtctgcagtggggaggctatatgtgtatggggggaaaagggggtgtatggaaactgtaccttccacttaattttgctgtgaacctaaaactgctctaaaaaatagtctatttttaaaaggcacatgattcaattacattttccatcaataacaactgagaggcttgggaatgatgacgggtgtggactgccccgggccccactcacctggtgcacgtccctcctgtatccggcatcgttgttgctgcccccgatcacatacagcttgttgaggagggttgccatgccgtgccaggcgcgccgcacaggcccatcagccagtgtgtgccaagtgttgctgcctggatcgtagcagtgtgtctctttcaggtaatcctcccctctgcggccgcaggtgatatacatcttcccctccagcgtcgcgcctgcgtgggcatacacctgtgtggagccaccaggagaaatggcgtgagagggcagtgaggaagggtggctgggtactctgtcaaggccaatcaccaccccacacctgcctgacaacgctgtgaggcttcaccacttcccactcacatacagacaagaatcctccctcgattctcatgggacatactgtcctagtcattgacctctaacctcttcccaatagcggatacatctatagactcagaaatgaaatgtagcctttgtctttcctttgctcctaaagttaacatctgcatgggggaactccaagaaaataaaagcattttttccaagccagtctggaagaagccacagaaccctggggaccgctgacccaccctcagtggcctccacccctcccccactcccactggacatgcaatcctccgggcctgctgaccctgcttttaaaatgtttgtaaataatatctgacactaaactcatgatgtggggagaaaaatacacatggttcttgattctggtcctgaaccttctgtgggctttttaccctccctctgttgggctatctccatagggcccagcctgcccccatcatgggcacctcttaccctggccctaccacttccggaacccacccactcacacccagcaggccaacagaaggccccaaggcaaggccctgggtgttttgagggtagaggagcccctcagggtgtggaggctccagagctatgttactgggcaagtcactaacactgaggccatgcgggtggcaaaaacacaagagtctagagaggtggacggagcagtggggaggaagaacacacaccaagggtttggtttgggtcttctcctatcaccagtaggggtctggggaggtttttctttttttttttttttttgagacggagtctcgctctgtcaccaggccggagtgcagtggcacgatctcggctcactgcaatctccgcctcccgggttcgaatgattctcctgcctcagcttcccgagtagctgggattataggcgcccgccaccatacccagctaacttttgtatttttaatagagacagggtttcaccatgttggccaggatggtctcgatctcctgacctcgtgacccacctgcctcggccttccaaagtgctaggattataggcatgagccaccacgcccagccgaggtttttctttttaattaaacttttcattttgagataagtgtagtcacgtgtagttggaagtaaaaatacagaggtctcacgtgccttctttcccccatggtaggagcctgtgtcactatatcacagggtcaccaggatgctgacgtggacacagccacagaactgtcctatcaccaccaggatcccgaggggctgccctttagggtgacatccactcacctcccttaccctaatcccttccttaagccctggaaaccaccaatctcttctctatttctacagttttgtaacttcaagagtgttgtctgaattaaatcagtatacaaccttttgacattggctttctaccccaacccaggttctaccaggttgttgcatgtacaggttgagtacctccaaaatctgagactttttgagcacaaacacggcactcaaaggaaatgcatttcagacttttggataagaaatgctgaaccagtaactataatgcaaagattccaaaatctgaaaaaatctgaaatccaaaacacttctggtccccagcatttcagataaagggtactcaacatgtaccaatagttggttccttttctattgctcagtagtattccatgggtatctaccacagcttgtttaaccattcactgttgaaaacacctgatttgtttccagtttctggctattaccaataaagctactattaacattcatgtacagataagttattttttatttttttgagacagggtcttggtctattgcccatgctggaatatagtggcacaatcttggctcactgcaacctctgcctcccgggttcaagcaattcttgtgcctcagcctccggagtagctgggattacaggcacgcatcaccatgcctggctaacgtatacagagtagttttcatttctctgggataaatacccaggatggtaactgccagatctgttttccagagtggctgtaccatttcacattcctatcagcaatccatgagcatagtttccctgcacagtcaccagtatttcgtattttcactactttttattttagtcatcctgaggtagttctctcactgtggctttaatttgcatttccctgatagctaataatgttacatatctccttatatgcttatttgccatctatacatcctcttcagtgaaatgtttcttcaactcttttgccttctgttttttgttttgttttgttttgttttgtttgtttttttttgagacagagtcttgccgtgtcgcccaggctggagtgcagtggcacaatctcagctcactgcaccctctgcctcctgggttcacaccattctcctgcctcagcctcccaagtagctgggactatagacgtccgccaccacatccagctaattttttgtatttttagtagagatggggtttcaccgtgttagccaggatggtctcaatctcctgacctcgtgatccacccaccttggcctcccaaagtgctgggattacaggtgtgagccaccgtgcccggcttcttttgccctctttttaatggggttatttgcagtattttgccaaggttttttgtttttgagatggagtctcactctgtcgcccaggctggagtgcaaaggcacggtctcggctcactgcaacctctgcctcccaggttcaagcaattctcctgcctcagcctcccaagtagctgggattacaggcgtgtgccaccgcgcccaactaatttttgtagttttagtagagatggggtttcaccatgttggccaggctggtctctggtctcgaactcctgacctcgtgatccgctcacttcagcctttcaaagtgctgggattacaggtgtgagccaccacacctggccgtttattgagttttaagagttgtttatatatgtatttatttaatactagtcctttgtcagataggtggtttgcaaatattttttaattttgatgaagtccagcttatcaatttttctttttatggctcatgcttttggggtcaagtctaagaattccttgcctagccctagctagatcctcaagattttcttctggtcatcacgtcgcgtggccgcagggagcagacccggacagctccagagcctccgggccggggcggcggcggcgacgcttcggctcctcctgagccacctgctggacccgcaccccactccatccccacaggctggggacaggccctggcgcggctgtgtgggatcagaagcagagttgcagaatccaaggacctatttttgttctttctccgcactgctttatgggaggcattatggcccccaaagacataatgacaaatactcatgctaaatcaatcctcagttcaatgaactccgttgggaagagcaataccttctgtgatgtgacattgagtagagcagaaagactttcctgcccatgagattgtgctggctgcctgtagtgattacttctgtgccatgttcactagtgacctttatagaaggggaaaccctatgttgacatccaaggtttgactgcctctaccatggaaattttattggactttgtgtacacggaaacagtacatgtgacatggagaatgtacaggaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgacacaagcagctgaggtttttagccagaagaattttcctgaagtggtacagcatgaagagttcattcttctgaggcaaggagaggtggaaaagctaatcaagtgcgatgaaattcaggtggatcctgaagaaccagtctttgaggctgtcatcagttgggtgaagcatgccaagaaagagcagaaagactccttgcccagcctgctacagtatatgcagatgcccctgctaaccctcaggtatatcacagatgtaatagatgctgagcctttcatccactatggtttacaatgcagggatctggttgatgaagcaaagaagtttcatctgaggcctgaacttcagagtcagatgcagggacccaggacaagggctcgcctaggagccaatgaagtgcttttggtggctgggggcttcggaagccagcagtctcccatcgatgcagtagagaaatatgaccccaagactcaggagtggagctttttgccaagcatcacttgtaagagatgttatgtggcctcagtgtccctacatgaccagatctacgtcattggtggctgtgatggtcgttccagccttagttcagtggaatgtctagactacacagcagatgaggatggggtctggtattctgtggcccctatgaatgtctgatgaggtcttgctggagccaccaccctgggagatttgatctatgtctctggaggctttgatggaagcaggcgtcacaccagtatggagcggtatgatccaaacattgaccagaggagcatgctgggagatatgcagacagcccgggaaggtgccggactcgtagtggccagtggagtgatccactgtctaggaggatatgacggcttgaatatcttaaattcagttgagaaatatgaccctcatacaggacactggactaatgttacaccaatggccaccaagcgttctggtgcaggagtagccctgctgaatgaccgtatttatgtggtggggagatttgatggtacagcccacctttcttccgttgaagcatacaacattcgcactgattcccggacaactgccaccagtatgaccactccacgatgctatgtaggggccacagtgcttcgggggagactctatgcaattgcaggatatgaaggtaagtccctgctaagtagcattgaatgttacaaccctatcatcaacagctgggaagtcgtgacatccatgggaacccagcgctgtgatgctggtgtgtgtgttctccacaagaagtgaccattgttggagcaccatccagagctagtgaccagtccagtggacagttagtgggagaatcaagaatcctttctagaatgtctgtttctcactatgtgcacagggtgattacaggcaccagtgcagtgatgattgtacttatttgacacatactccccctcgtcctggttgttgttcctgagaagggtgggtaacagatactccagggaaaagaatgcacattgaatggatgtgagagaccacattacctctcccactactttggggagcactttcctgtcatttctaacttaccacgtgcttggtgtactatatgtatgttgtgcctcatatgttgcaaagaactaaggtgagtatagcctactagatgtgagcaatatccagcctagatgattggaaagataccaatttaagtaaacttggtaaaatccaagtcttttttttttccaggaacaaatacattttctaatctacaggtagctaggggcaacacagttccattctaaagggaaacaaaagggagagccccacaaaactttgggggcaagggagagatactcatctgacacttcttttggaggtcagggtttgtatatcagaattgaagttagaatcagtgaattaaactgaatttgatggaatgtgagtgaacctagaacagcactgaagtattacataacctggaagactgagaagggtatattctttgaatgatctttttatttccccaaggtctttcacactggagacagcataaaagagtgaaccaatgttgggatgagagaagatgacataaatgtgggagttcagtataactggggataaactagaagtacctgtgattttacagtcatcttattgcctgccaggggtcatctagccatggcagtgttaaccttgaatgggggtgaaagcctttctttgttgaatcaaatactactacactattacacttccacactatttatttggggatggactgggagtgacagtagcctagtagttcagctacctgattactgccccattcttttagaagcacacttctgccaaggagtggtttgtactgctgtgattggtacatttagtcttttttctgctataagttttccttacctgtcctttagtgtagattttattcattacaggacagaataatcaaggacaaccaaaatccttttgttagtttcagtacctcagctatcaacatttctgagctatcattcaatgttcctctgtgtcatggagtgaaattcttgttttatgggtattgggagtgtgggaatgtgataacctaaacaacctttgctctgaaattccatttttccctctttccctgaagtgtactgacctgtactacagagttaatttcttttgtatttttttaagaaaatattaaaaatcaatggtctcaaaaaaaaaagattttcttcttctttttttctagaagttttatggttttacatttaactccataaaccattttgaattcattttggtatatggtatgagacttgggttgatatccatttttttgccgacgcatgtctaattgctccagtactatttgctgaaagatatctttcctccactcaattgtttctgcacctttgtccaaaatcatgtgtaacatgactgggcatatttactcaggtctgtgggttttccattctgtttcactgatctatgtgtctatcactgtatccataccacagccttgattactgtagctatgtagtaatcttgaaattgggcagactcctcccatcttatcgttctttttcaaaattatttgagctattctagttcctttgcctttatatatacatttcagaataatctcatttacatctaatgtcacaagtaaaatcaaatcaaaattaaaaaatttattttatttattttgaaatttattttattattattttttgagacagtctcactctgtcgcccaggctggagtgcagtggcgcaatctcggctcattgcaacctctgcctcctgggttcaatccattcttgtgcctcagcctccccagtagctgggattacaggtgtgtgccaccacacccagctaatatttgtatttttagtagagatggggtttcaccatgttggccaggctggtcttgaactcctgacctcaagcgatacaccatcctcggcctcccaaagtgctgggattacagacgtgagccactgcgaccagcaataaaaaaaaattttaggctggatgtgatggctcacttctctaatccctgcactttggccgaggcagacagatcccttgagaccaggggttcaagaacagcctgggcaatatggtgaaaccttcatgatactaaaaatataaatattagctgggcatggtggtgctcacctgtaatcccagctacttgggaggctgaggcaggaggatcacttgaaccagggaggcagaggttgcagtgagccggggtcatgccactgcactccagcctgggtgacagagcgagactctgtctcaaaaaaaataaaaataaaaaaatttttaaaaagcttattgtgcatgtaaaagaagagttcatgaaccaggaaaccccaaactggaagtggtatgaagccccaattcacagcagttacaacacagtttataaagcatgaatgaggaagaatattgttccctactgtgcatgtggagctgcataagctttctttgtaaagctatcacactgagggaggaaagcttaagtttcagttacatggctacaggcagttggcctaggggtatatccaaacctcagcttcaattttcattttcccttaatagtacaaaaaaccttcctgaaattttgataggaatactagtattcctgtattaatactatatcaatatgaggaattctgtattaatatatgtattattaattgggttgggaaagaactgacattcttactattcttactcttccaatccatggacttggtatgtctctccatctattcacatcttcttttatttctttcatcggctttttgtaatattcagtgtaccaatcctgtgaggttttttgtttgtttgttttgagacggagtcttggcagagtcttgctctgttgcccaggctggaatgcagtggtgtgatctcagctcactacaacctctgcctcccgggttcacgccattctcctgcctcagcctcctgagtagctgggactataggcgcctgccaccatgctcagctaatttttgtatttttagtagagatggggttttaccatgttggccaggctggtcttgaactcctgacctcaggtgatcccccccgcctgggcctcccaaagtgctgggattacagacgtgagccaccgcgccctgccaacatgacctatcctttttcattccccaacatctgatccatcagcaagcctgatcagtttacctccacgctacactctgaaccctcccatctccctccagctccacagctgtgtgccagcacaggctactgctgtcttcagcccagaccacgcaatgacccagggccagcctcgcttgctctgctcttgatccttgggcttccttcttctacaagcatgccccatgcttcctctcctgctcaggaaaagctgtgagcccctctcctgccctggaaggtccttctgctagactaggcagatggttagatatgagcagggaagtggactccaggttggcctcagcccctagcatggccagagggactatgacctctgagacatgttaaccacacctggggtttcaaaagtcccaacccctctttcagttaagcttatccagctcaagtaggaactaaccccacaaggaactttccacccccgggagcctgtgttgtatagtttgccccagttttgcttgcttcgaaagtaaccttttgttcactgcagtggtaaaaaacacacctcctgggtgaagatttaagatgctaatgagacatgcgataaatacactagcacgtagagccacagtgcatgcgctgctagaagaccacccaaacaaaacatgcttatgagtaacacctcttcccgcccatttatgaataatcatgtaagcctcctgtaagggaggtttcccatgccagttggggcgatcttattctggagcagcctgctctgactcggccttcagaatgtaccttcacttttgcaataaactgccttacacttatcttcgttaatgcatgtctcttgcttaaagtcttaaccaagaagacaagaaccgaggacacattcccagtaacatttcctccctctgtaaatggcaggtctaattgacatctcctcagatggacattccccaaaaagtccctctagattcatcctaccagagccccctccctggaaatcctccagttcagccccctcttcatttcacttaccataattgtaaccactttactgatctgttttctggttaagagtggtttctcctacaaggctgtaaacaccatggagtggggagtctttctcatttcttgtcaccactggattcccaggacttggtacatggtgcttagtagttgcggaatgaatgcgtgcatgaaggaacaccggcagccacgatgcagctggttgaaagccaaggctgcccctctgtggccaagctggagaactgctgcttccccagctgccgcagacaaagaaactgctaagcccctcccacaacacccacctaggaggcttcccccaacacccttcctggaacagaacccaagagccctccttgtccacttggtctcaaggacctcctgatcttctccatgcaaaatctgctcctttccccaggatgggggtacggagtgtccttccaaagaggcttccttctccccaaagaagctgagagcaaggagcaggccacagcttgcagctcacagctgcccaagagacagaaatctgtgtgggctgtgtgaatgacctggataaagaagagctggatccattgaggagacactagccctgacccctgaagtcaaagtctaagtccctgggggaattgggggtcatgagagatactggaaagaggcttacaaaggccagagctcttgctaaactccctgaggcagtgcaggtagaacctgccccccataccatcctctgcctctcaggtgctcggttatccccaaaggtgtacctggcccatagcaggtgctccacaaatgctatgccagtactagcggggtgccctgctagggtacccctagtactgctagggtatgccctgttctcggaggctgagacccaggaagtagggggccagcaaggcctgttccttccctgggatcccatgtctggttgttacaccaggcctgagtaccccaaagtcgtaagataaaagagaggcacctccctaaaacatcatttttccataatgaacataattttaaacatcttcaaattggaataaaccaaggtattatataggatgcacgtgatttttttttcaagttgtcccaatattcaaacataggatttaatataaaaaataaaaccttagagtgtttcttggctctggaaggcgccacccttcaggggacctagagggaagaggtctgaggataggccagtgagctctcagggtcccttcctgtttaacatctctggaagtgtcccagctcgtctcagctgcacaaagagcaaatgttctatccacatttgaactacaaggtttaagcagcttgccagggccaaggtggtgtgacaaggtctcagcatgtaagactcacaagtggggcacaattctgagcaatggggtctggatccttgatgagcctccccaggtggactggctgaacctcatggggcctcatcaatgcattcaatgcagggtctctggagaagcatggattctgctcactgagcctgtttctctgacctgggacaggccttgacacctaggcctctcactctttgcacatcctggggaaggaaattaggcaggagaaggcccctcttcgagggcttccttacctccctcttgagtggggccacgtatgcccaggagttggtggcagggtcgtagcgctccacagcattcaggtcattgtggtagtcacggcccgccacagcgtagatgtacctgcctacaacacacacggacaggtcggcgtgctcctgctgcagggactggatctggaaccagcggttgtgccgtgggtcatacctgtgccgagacatgaggaaagcacagcactgactaggcagggaggctgctccgcaggcttgcacctcttgttctggtcccatttctgctttgcctcagcccagcctgaaccctccccaactaccccacataccagtgcacaccgatctacagccaggcccacaggctgttacacacctgagcacaggtgctccccaccacacagcatggaaggaatggccaggagcctcctgtgtttccacctaactgtccacctgggctgtccaatggctctttttttttttttttttttttttttgtggagagaggtctctctgtcccctaggctgaagtgcagtggcacaatcatggctcactgtagcctcgacctcctgggcttaagtgatcctaccacctcagtctcctaagtagctgggactacaggtgcgcaccacaacgcccgctatttttttttttttttttttttttgatagagacaaggtcttgacacctgggatatggacttaggcaatcctcctgcctcagcctcaatggctgttcgtacagccacttccatctcacttacctcatctcatcatccacatagccttgctcccactcaggagggcctccaaatacagcctctccactggatgggtgccatcagccccctcattggcctccaagccttgaacttcccccagcactccatcaggagtggtcttctcaggcacgccctgcacacagcacccatcataccctcagctttgtcaacagccgcacacacaaggctctggtcatcgtactttcacctcctcccaccatgctgccagccccgcgtttcctgacctcccctccactcaaggtctccctctctgggaaagtggaaagggttaactcccaccctggactgcaggctctgtaagggcagggtgtgtgagattccagggacccccatgggagaaaaggcactagactggttgcggcaggcccacgagggtggaggagtctggccaggacccaaggagggctcctgggctgagcaccaacagggagcatggcctgcaatgtggagcagagatgatcacagagccatgaggggccaggacccagtgagctcaaagccagtatctgaagtgtccttgcccaacagcccacagatagttacagcctctttcagacaagtgtttttatttctgcagaggaagacctattccaaagagaacaagtctaacttcaactggctcacaagagagtaaccaaagttttctttggcctgtgccctatgctggttagtgaaaagatcagtttcatcctttgcttcctgcagcccctgcagtgtggccagcccctccccgccgcctaccaggaatgcagcaaacaggagcctcagaaggcagggccaacaagagagggaacacacacctgggtctccctgacctggtgtgaatcctgggctcttccctgtctagctgggtgtgcctgggcatcagttttaatctcttgggattcgctcagttctgcacctgtccaatgaggtgatatcacctgcctagaaaagctatcaagaagaatcataaaagacgagcatgaaaagtgtccttgttaacttgggggttctgatggatcatggttcatttctatattcctagacctcagtgtagcctctggctcaggacagattatgttctgtctgctgaatgaattaaacaaaggagtaagattaccagcaatgaatcattcattcactctaccaacattcccaggtctcccactgtggatggggcacagtgctcagcactacatccagagggagcctcaagaggtcagggccctgccttcccctgcagaatggaaacaggctaaccagagcaaatgagtgcttaatataatgacagacactgtgaaagaaagaaagggaggtaagaagatgagtgacctgctggtcagcggggcctggggagggcagagctcccttgcagtgatcaggaaaggcctcctgagaaggcagggtctgagacctgcatgacctggggcacaagccagaagaaggtctggcaggggaccagcagtccaggattggggcacagcactcacaggggccccgtcaactggctgggatggtgctgttcactgcctttcctgtgcgccttcctcctttatatacaagtctctcctctcttgtgttcagtctggctcaatcaccatctgcaccccaagtgtctgcaaccagagtgagataggaccctccatgtgctcctgtttgctccttcgagtctattgtcctcacagctttttaagctgagttcatgtggatttgtggcttcaaatttaaagacacacacagggccgggcgtggtggctcacgcctgtaatcccagaactttgggaggctgaggcgggtggatcacgaggtcaggagttcaagaccagactgtccaatatggtgaaaccccgtctccactaaaaatataaaaaaattagccaggcatggtggtgtgtggctgtagttccagctactcgggaggctgaggcaggagaatcacttgaacccgggaggcagaagttgcagtgagctgagatcatgccattgcactccagcctgggcgacagagtgaaactccatcccccaaaaaaaaaaaaaaaaaaaaaaaaaaaaaaaaaaaaagacaccaacagtgataccatatgtcaataatttagacatagccaaagttacactgatttcttatttccctgttgtgtcctgtatccctcttcttctttattgaattaattttctactttatgagaataagtcctcaagtaatatttttctaataaaaataagctttatttttgcatataaagatataaacaattttacttattgctatggactagatgtttggattcccccaaaacccctatgttgaaggcctaacccccattgtgatggtagtgggaggcatggcctttgggaggtgatcaggtcatgagggtggagccccatgatgggcttagtgcccgaggctacagctctttctctccaccatgtgagaacacagacggaaaggaccttaccgggactaaactggccaataccatgatcttggacttcccagtatccagacagtgagaaatagaggtatgttgtttaagtcactccatctatagtatttgttatagcagctgaaactgactaggagagtcactttaactcagatttgtatcatcctattgtaaactcagacatgaaccctagagttggtacaaaaatattctggaattcttgttaaattcattagactgtggccaggcacggtggctcacgcctgtaatcccagcactttgggaggctaaggcgggaggatcatgaggtcaggagatcaagaccatcctggctaacacggtgaaaccccgtctctactaaaaatacaaaaaattagccaggcgtggtggtgggcgcttgtagtcccacctactcgggaggctgaggcaggagaatggtgtgaacccaggaggtggagcttgcagtgagctgagatcacgccactgcactccagcctgggtgacagagagactccaactcaaaaaaaaaaaaaaaaaaaaaaaaattcagtagactgtttttcttctatatttccatgacttaagtattttcatgactattaatgttttaatgtctattaaattttttaaataaattaaatgtactgaccgggcacggtgggtggctcatgcctgtaatcccagcactttgggaggctgaggcaggcggatcacctgaagtcaggagttcaagaccaacttggtcaacatggtgaaactccatctctactaaaaatacaaaaaaatggccgggcgtggtggctcacacctgtaatcccagcactttgggaggcccaggtgggcagatcacctgaggtcaggagttcaagaccagcttggccaacatggtgaaaccctatctctactaaaaatacaaaattagccaggcatggtggcgtacaccggtaatctcagccactcgggaggctgaggcaggagaattgcttgaacctcagaggcggaggttgtggtgagccaagattgcaccattgcactccagcctgggcagaaaacagcgagactccatctcaaaacaaaaaaacaaaaaaacaaaaaaattagctgggcgtggtggtcggcgcctgtaatcccagctattcaggaggctgaggcaggagaatggcttgaacccgggaggcagaggttgcagtgagccgagatcgtgccactgcactccagcctgggcgacagaacgagactctgtctcaaaaaaaaaaaaaaaaaaattaaatttactttaaaatattagcagccatgaaatgccgaaggaaaaattacattattatttaaaaaattttttttagagacagggtctcactctgttgcccaggctacagtacaggggcatgatcatagttcaccgaagtctaaaactcctggactcaagcgatcctcctgcctcagccttccaagtagccagggctgcaagcacgtaccatcaggcccagctaattttttttttttttttttggtagagacgaggtctcgctttgttgcccaggctgatcttgaactcctgggctcaaaagatcctgctgcctcagcatcccaaagtgctgggattattgacatgatctgcacatagcctaaattattattttaagtagggtcagggcacatagcaacatgtaaccagctactactaggtataccatgtagttggtgttcagtaatccacagggctatggctatgggaaaggtacaaggaatgatgcagataatatagatgcaaagaaagaaggaatgaaagagaaaaagtagtatattggagacaaacaccatttgctccaagagaggaaaggtttttaaatatgcggtttctgcaccaatgctttaagatataacctggtaagtaataactcctcaaaatgcaaagcctaatttactgcaaaatcttgtttccttatattctaaaagcctatagcttttagaattcaccagttctaaggctgatgaaatgagaaagcagagaaagaaccaaatcttagaatattcaaattaaggattcatctggaagttttgagtccactggaaggttaatgatgccttcattctggagagatgatacatccctgggttaaccagtagggctgtggtccttcctgccacctccactctgtggatacctactctctcaaggcaggtcttgccgaccccacttgccattgtgatcctactctcagacaggagtttgggactggttattggttacagggtctaatattagcattacccagagttcagctttggtctcacaccccttcacaaggggaaattcagactcctactttaagtgaaagtgagatcaatggcccatagcaggtggacagaggacaggggcaggcagaatcccaagctgtcacccccctagggacagctctgtggaaacatccagcattactgccaagcacacagctgtctctaccttctgctaagggccagaagccaaaacactctggagagattggctttgcaggtctgtaggttactctcagcagggtggtctggccttggccccccaactgggaaaccgagccccctaaaaaagaaggtttaaggtttggccaaagggaagtctaaacctagtgtggccacacccactgggggcacaactttgtttagagaggaaatgaaggtagctgtttccttttttctgaaacctgcccttcctcatatttaaccacaatgtgttattgccaacctctgagtctcatcagcttaacaaaggagatcacttcctggggccagcagtagagaggtcgctgagaaatggccttctcctccttggccaggatcactatgcttgattccaagtggcatggccaggccaggccctaccccaccctgaccccagaaaatagaaacatgaacatgaactcagtcagcatctagctcatggctgctggaaatagttggcaatctctctctctccaacacagctccatctttcagcatgaagggtagggagatttctcacatgcaccaaggtaaggtggaggggtccctggaaatctaatggtagctgagtcttgtgggcctgaaccactgtcccttgctctgcccagaaatggatttgtgagatcacagcctaagtgactgatggagccaggcgcatcctacggaccacagcagtccacaaaactctctcttgggaaaactgcctcttcccaggggaaattgtgccaagtgcgtggcagactgcagggcagagcggaaatgtagcatgaggctcggtgatgcttgttggcctttaccacgcccctgggctgaagaccgcatgctgctcaggcacagcagcaggaagcctgttccaccattagcaagcaggtaagagagaagagcaaagctgactggtgaagggaaactgaaacaacatgcatcaaagctcagagagagcatgatggagggcgaggctgctcagctggcactgctcctaggtcctctccatcccagtccgactgcctttcctgctgtgggctcctctcccctcccgtctcctcctgcacaatgcactcgcaacctagcctaccccaaagaggctgagcaagggtccagggtaagtgggtttctgaggagtaggggacatgcaggaaagaaggcgatccacatgtccccttctcttatctcactgctgtccaccttctctgaattcacctagacttcattccacaatggcaagtgatgctcatgtgaaaggctggggggaacctgaccagctctctcagcccatgacttccacaccctctcatcacctgaagacaaagggaccagctagcaccctgtcctacctccagcatcgggactctgctcgaaatccttggacattgttgtcccctccaatcaagtatacgaagttgttgagcaccgcgatgccctggttggacatgcggggggccagggaggcagtgaagtgcttccactctcccagtaaggggtttagatacttggcctggtcgctgaggacagtggacggcgtggagtgaatgcccccgaagcccacaacgcactggaagtccgaccgcagctccgtttgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtctcaaggagctttgggggctcgtgcagcgagatctggtcagcctgcacctgctccaggctataatggtagagaagggccccctcatatacctcggtctcgcaggagacctccaggcgattgctgctgaggagggagtagaccttctccaatggaagctggcggtacttgtcagtccgagagaaggccacaaagtttttgaggatataggtgtccagttgctcagtcaggcggctcaagtcaaacagctctgccagccggtagacatcgagaatgttctcttcgtccacccaggacatgaggaaatcacagcagaaatggataatttctgggatctgcagagagaatgacacccattcaagcctgggctggtgaacagcatctgggggtgggagagagaatgatggcagaaatacgggctgttgtgggccaggcaaagcagaagggaagtcctccttaattgtccccgaccttttctgacacactggagactggggcttactgcagactaggtttaagtcctggtttggaaacatactgggtgacaggatatacagcatgtttttttttggttttgttttgcttttctttgagacaaagtttcgctcttgttgcccagaatggagtgcagtggcagaatctcggctcactaacacctccccctcccgggttgaaatgattctcctgcctcagcctcccgtacagaatgtttttaacctctctaagcctcagtctcctcatctataaaacggggatcattaaagtgaagaggaacatgatgaaaatgagagagcacataggagtggacccttgatatatgtcagttccctcttagatcaaaagtactggctcggccgggtgcggtggctcatgcctataatcccagcactttgggaggacaaggtgggtgtatcacgaggtcaggagtttgagaccagcctgaccaacatggtgaaacaccgtctctactagaaatacaaaaattagctgggcgtggtggcgcgcgcctgtaatcccagctactcaggaggctgaggcaggagaatcgctggaacccaggaggcggaggttgcagtgagccgagatcgcgccattgcactccaacctgggtgacagagcgagactccgtctaaaaaaaaaaaaaaaaaaaaaaaaagaagtactggctctccagaaaagcaggaagcagcacaaatggtcactgtgtcatatatctgtggtttggaaaggacctaagaccatccccatccctaccctaggattctctggaagagcctgcctctccaaaagcgctgggaccagaaacaaacctggctttttcccccgccagaacatccaccctggttccctagaagtgctcagagcctctcagacacctaaccaatacccacccaggaacctgatttagaattatttttcttttttctttttaaaatttgagacagggtcttgctctgttgcccaggctgcagtgccatggcaagatcatagctcaccgaagtctcaagcttctgggctcaagtgatccctgactcagggttcttgaggttcccagctgggtcaagacccacttgactccagtaagtgcaggggctcccaggtggccatatcaacccttcccagccatggggaagcactagtggtttgaaaggacggcaagagagagaatgacactggagggaggtgggaacaaggccacaaccagcaggctgttaaaggccaccctgtgaacagacaaccaaatcttgggagaataggagacaaagggaagggccctagggaaaactgcctgggagaacaaaccaggtgttgataaattatttaggaaagcaggattttagagtttcagtggggccccccagtgcccacctcctttctttccatgttcagattgaaaatgacgagtaccttgacctctctgtgacccagacagctgcaggttctcccagcaggcttgaacccaaaccaggcccttgaacattcccaggcactgataaaggcatcaaggttgttacccaaaacactgaaggaaaaactggttctggccctgagacaaattccttaaaccctcatagaaactccatacactaacccactctgtgggcaagcctgggtaaagcctctcttttcccttgtctgtcttgaggacatgctacatcactctatacataagttcccctaataaacgctctggccagatcaccctggtgtttgatgcttctttctttggaatcccaaaacggctccatttcaggatgctgtggggtcccctcttgtgggaacccccttgctaccaactccagccatgtgttcaatgcaataaatcagtttctctaaaaatgggaatacctggcttatccaggatcatcaataaattaaccattacacatggaataattctgctggtatttatgtatttatttatttattattttgagatggggtctcactctgttgcccaggctggagtgcagtggcacgatctcggctcactgcaagctccgcctcccgggttcacgccattctcccacctcagcctcccaagtagctgggacaacagacgcccgccaccacgcccggctaattttttgtatttttagtagagacggggtttcatcgtgttagccaggatggtctcgatctcctgacctcgtgatctgcccgcctaggcctcccaaagtgctgggattacaggcgtgagccacggcgcccggccaaggtatttaaagcttatcaataaacactaactataacttttttaaaattcaaaagacatctaatattgcttgcaaggtgacatgctaagagctggatgagacctaccaaatgtcaggcaggtatgtgccctacatgaggtatccccatggtgctttgctaggccctgaccagcttcacttgaccttcttttttccctttttgccagtcttctgctttgccacttcttcccaaactactaggttttcctaaaattctggtttgtcatgggccagggtcctgaagaccaagttttgggcagaatgtgagcacaaacagccctgaagaagcctgggcagcagcagctccttgagaggaccctgctgactctcctttcagtcctatttttagagcagtgggccttctgttcagtgaaatctcacagaggaaccagcctgggctcaggatgtgcaaaagccccatacgaggctcacagaagggactgcatttgcttggggtaacccaataggacagtgttactgggaatcagactcaggcctctggggacaccgtgaagaatctggtcccaggcctactgcagggcacaacacatgggggaagcctccaaaagtcactagctatgtgaacatacatgattctacaggcctatggacttgacatggttatgccaagtaaaacctgctataaaacaatattgtgaagaagcctgtttttttttgtttgtttgttttttgttttgagataagctggcatgtagtggtgtggtgatcacagcttactgaagcctccacctcctgggctcaagtgattctcccacctcagcctcccgagtagctggaactacaggtgcatgccaccatgcccggctatttttaaagtgcttctgtagaggtctcgctttgttgcccaggctgatctcaaactcctggcctcaagcaatcctctcaccttggcctccaaaagtgctgggattacaggcatgaacctccaagcctggcccagaagcctgatatgttaaaaaactaagataggctgctgcctctgagatgacctctgaggcactgggggagatgacccagggctgtcgggagcactggccaaaccaacagagagagactgcaggcctccaagctgactggtgagagagggaaagtgatgttagaaagatgatctggtttcagtgtgtgtgatcactgcagggagaagaaagaaatggcagaaacatacagatggaggccaggcaaaagggaaggaaatggaaacacagaacagagatggctacaagcaataccgagaaggatgacctgtcctcacatggacgcagggaattaagaaggtggacgggctcaaggagccactgaggttgagcccagggaactggcaggatggtcacaggacacacagagcagggggactgacaggggagctccgggagagtggcaggtgtggaggaggagataggacagctggacctgagccatgctgggggagatgtttcagaggcagctgaatcaggagttaactgctgccagggtggagaattggatgagggttcccaaagcaacaatgacagggatgtggggacagaagagatctctaaataaaagaacagggggaaattcttttgttgtaaaagccaactccatctactcaccatgcaggtatggtgagacaagtcagtcatctcagatcaacccacccagcatccaggtcctatccaccaatctgagaacagggcacagggaggctgccagggccctgtcacatggggtggcacctccacatgcccccgaacaggttggttttcctgtgacttgagttgtttttttttaattgcgtcaaacctgctctcatgggaagaaaggtcagaatgatgaacttagcatagcattttgtttcacttttaagaaatgtgggaagaggtgactgtcaactcctatcaggcctctgcctgatagctcaaaggcacctgcaggcccagtcccgtgtaactgcacccacaccactgagaataatcatccaaaacataagtcacactgtcaaagcctcagaaaactttttgaattctgcaggaaaacaagtacttaaagttcaataacaggttgggtacagaggctcacacctgtaatcccagaactttgggaagccaaggtgggagtatcacctgaggccaggagcttgagaccagcctgggcaacataacaaggccccattcctataaaaaaatatatatatatataatatcagctaggcacaatggcacgcatctttagtcccagctactcagaaggctgaggcgggaggaccacttgagcctaggaggtggaggctacagtgaactatgatcatgccattgcattacagcctgggtaacagagtgagaccctgtctttaaaaaaaaaaaaaaaataggccaggcgcagtggctcacacctgtaatcgcaacactttggaaggctgaggtggatcacttgaggccaggggttcaagactagcctaagcaacaaagcaagcctctatctctataaaaataatttaaaaattagccaggtgtagtggcacatgcctataggtcctagctatttgggaggctgaggcagaaggattgctggagcccaggaggttgaggctgcagtgagctgtgatcgtgccactgcactccagcctgggcaagagagagagagcttgtctccaataaattgaatgagtggatggatggatgggtggatggatggatggatggatggatggatggatgcatgcatggatggatggatggatggatggatgcctgccaccatggatggatgcatgcatggatggatggatagatggatggatggatggatggatggatggatggatggatggatgcatgcatgcatggatggatggatggatgcgtgcatgcatggatggatggatggatggacagacaaatagatagataaagttcagtaacaaaacacataagttttcaagagactgaagtggcccagtgaggggacaggcaggaagggccctggcagcaatgctggtggatgctccccattgccagaccccagagcacacaggacgtccacatgcagcctcgggtcagcctacctgcttatgtgcaggatgctttcaatgacagggagactcagacagtggggaaacaaccagcaatagagaagagggcaaaggcagaggcctggggtgtctagagcggctctgcttgagctccaggaacaactccagagtcttccccacttcatggccttcgtcactgcttggtctcctcacattcctgacccatcttcaagccaatgctagtgcccggcaggcatcatgggcatctcagggaaccccacctgggtgtgggtctgccttgctagatgagacatgcctcacctgaagctggcaggcagccaccagtgtctcttgtacattgctcaggctgagctccagctcggaggtgtatatgaaatgtaggatttggcacatagcattgtaggacacaccgtggatcaggacctcttcctgttccatctccttcaatcccccagcaaacattcctctgcaaagtgaagacacaagaaaatggagttataccaacagggacttaagcccatgttgccaagagtgacagcattcagagaagaacctggcgctggtggcagggccctggtagtgggctgacccactctgtgctctgagtgaactgtgtgcatgcatgagccatcccacaaaaggatcctgacgaagtctgggcagccatcctggaaattgtcctgtttcccttttcatgggcccaaggagtcccatgtgagcttcgggaggtgaggccacaagcagcttgcttctgctgtgttcatcagtgcagttcctggatcggagcagtagcaactccagagcacatttcaaagcaatgaattaattaatgggaaactaataaaagtcatttcattcaatgtatatttatggagttcctaccaaatgccaagtatcattcaaagagcagaaggaggccaggcacggtgactcacacctgtaatcccagcactttgggaggccaaggcaggcaaatcacttcaggtcaggaattcgagaccagcctggcccacatggtgaaaccgcgtctctactaaaaatacaaatattagccgggcatgatgttgtgcatctgtagtcccagctactttggtggctgcggcacaagaattgattgaacctgggagacggagggtgccatgagccaagattgcaccactgcactccagcctgggcaacaaagcaagactgtctcaaaaagcaaaacaaaacaaaaaacaaagagcaaaaggagttatagtgaagtaaactggtaaaatagctgggcgcggtggctcacgcctctaatcccaaccctctgggaggccaaggcaggcagatcccttgagcctaggagttcaagaccagcctaggcaacacggtgaaatcctgtctctacaaaaattacaaaaattggccgggcgtggtggctcacgcctataatctcagcactttgggagggcaaggcgggcagatcacctgaggtcaggagttcaagaccagcctggccaacatggtgaaaccccgtctctactaaaaatacaaaaattagctgggtgtggtggcgggcgcctatcatcccagctactcaggaggctgaggcaggagaatcgcttgaacccgggaggcggaggttgcagtgagccgagatcacaccactgcgatccagcctgggtgacacagcaagactctgtctcaaaaaacatatatacatatataaataaatgctaagaaggaacccagcagggcatctgacctgagagtcactggttagaagaggggtaggtggaatgatgagaaggagcagggaaagccccatctgaggaactgagacctaaggataaggctgagagggtgtaggcagccggggagggagttccaggtgaaggagacaggtgtacaagttctggggcaaggcagagcttggcatgcaaggcagccaagatgatgacgaagtgagcagaaagtgggatgggcaggcaggccttggagccaggtccccctacctctagggtaggtacagtccagattgaaatctgagcattatgggatgctcttgaggaatttacccacagagtgatgtgaactgactggctttccgactcaggtgctggaggaggagcccctggaagaccaattaggcctgagattcctgtgggcctggaggccaagggtgaccctggccctggggagggcattgcagctagaaagcagtagctgagactaccctgggacacggcacagagaacctactgacagactgaatctaggaggacctgggaggactcaaggccctctgctgggccgaagaggaccctttactgatggaagaaaatctggacagctgggagtcccgtgattgtgtgatcagtgtgagatacctgtgaaacctccaagtgtagacactgattaggtgtttggaggtaagaggctggcaactggggctgaagtttaaatatgacagcaacatgaagattataagagaagctatttttacattttatttatttttttgactaggtaatacatatacatgctaccagatttaaaatacagtataggttaggccgggcacagtggctcacgcctgtaatcccaggactttgggaggccgaggcaggccgatcatctgaggttgggagttcgacaccagcctgaccaacatggagaaaccccatctctaccaaaaatacaaaattagctggtcatggtggcacatgcctgtaatcccagctactcaggaggctgaggcaggagaattgcttgaacccaagaggcggaggttgcagtgggccaagatcgtgccattgcactccagcctgggcaacaagagtgaaactctgtcacacacacaaaaaaaatacagtataggttgtggtgaaagtccccttgcctctgctcccagaccatcagtcagttcccctcccagggccacactatcctcagggcagtcatattccacatctcacttggcttttttcttttttttgagacgaagtctcactctgttgcctgggctggagtgcagtggtgcgatcttggctcagtgcaacctccgcctcctgagttcaactgattctcctgccttggcctcccaagtagctgggactacaggtgccccccaccacgcccagctaattttttgtatttttagtagagaccgggtttcaccgtgttagccagaatggtcttgatctcctgacctcgtgatctgcctgcctcggcctcccaaagggctgggattacaggcgtgagccactgcacccagcccggtttttacttaacaatatagcttggagactgatccatgcccatgtacgcaagactgcctcactctttgcaaaggctgtctcactttttttattttattttatttttttaagatggagtttcgctcttgtcgcccaggctggagagcaatggtgcaatctcggctcactgcaacctccgcctcccgggttcaagcaattctccaaactcagcctcccgggtagctgggattacagtcctgcgccaccatgcccggctaatttttgtatttttagtagagatggggtttcaccacgttggccaggctggtctcaaactcctgacctcaggtgatccacccgcctcagcctcccacagtgctgggattacaggcatgagccaccgcgcccagccagctgtctcacttctttaacccatttctacaggggtatatttaggttacttgtaatttccagttatttcacatgatgaacatcctcacccttacaacatgctgagtatgcatatgccaggattaagtcccacaaatacagttgctgggtcgaagggtttacatacatttatactttgatagtattgtcaagttgctgtttttatatcattcctgatagcagggcctggtgcctgcaccctctacccccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctttttctttctgagattattcagaaaacatttccgatattttcctctagtgtttttattattgaatctttcacatttaaaactgttgatccacctgtaatttattttggtataaggtatgaagcaagggtccaactttgtttttctagatggcaactctgtcgtcttccctccttcctctaatttttttttttttttaagacgaagtctcactctgttgcccaagctggagtgcagcagcgcgatctcggctcaccacaacctccacttcccgggttcaggagattctcctgcctcccagcctcccgagtggctgggattacaggcatgtaccaccacacccggctaattttgtattttcagtagagatggggttatcactatgttggccaggctggtcttgaactcctgaccttgtaatccgcctgccttgggctcccaaagtgctgggattacaggcgtgagtcaccgcacccagccccttcctctaatttttgaggctatctttatcacataggacaggaatagtctcctttcgttacttttgttttcgacaatttcctggccactgctagctttttacatttgaattttagaatcaagtttctgtaattgccccaaataaaccctcttggtattttagggggttatgttaaacatctaggttaatgtagagataaatagcatttttataatggacacagtggatctttttaactgtccagccatcctctgggtccatttggaagtcttataagtcatcttcctacagatctggcacatatttgttacatttattcccagacatttcactccatgcatggccaagccctcggggcactttcccatgctctttacagtggtctgtctggctctcctggactttccaggactgtgctcgtgcatgtacttctgtctgattcttctgctggcacctctgggactatattggcagcagtggagatggcaacatttcaagcactgcccgccctgagcagggtgtgggtgcttggattgacacagatttttttttttttttttttttttttttgagacgaagtcttgctgttgcccaggctggagtgcagtggcgcgatctcggctcactgcaggttccgccccccggggttcacaccattctcctgcctcagcctcccgagtagctgggactacaggtgcccgccacgtcgcccggctaattttttgtatttttagtagagacggggtttcaccatgttagccaggatggtctcgatctcctgacctcatgatccgcccgcctcggcctcccaaagtgctggtattacaggcgtgagccaccacgcccggcctttttttttttttgtgacagagtctcgctcttgttgcccaggctggagtgcaatggcgcaatctcggctcactgcaacctccgcctaccacgttcaagcgattctcctgcctcagcctcccaagtagctggaattataggcatgtgccaccacgcctggctattttgtatttttagtagagacagggtttcaccatgttggtcagactggtctcgaactcctgacctgatgtgatccacccacctcggcctcccatagtgctggattacaggtgtgagccaccacgtctggccggacacaaacttttaccattttaagaaaaaaaaaaatcttataatcctttcgggggccaaggcaggaagactgcttgaggccaggactttaagattagactgggcagccaggcaccatggctcacacctgtaatcccagcactttgggaggccgaggtgggcagatcacttgaggccaagagttcgagaccagtctggccaacatggtgaaacctcatctctactaaaagtacaaaaattagctgcatggtggtgcacacctgtaatctcagctacttgggtggttgaggcatgagaatcacttgaacctgggaggcggaggttgcagtgagctgatatcgcaccactactctgtgacagagcaacactgtgcctcaaaagaaaaagaaaaagaagggaaaaaaaaagaccagatggggcaacacagaaagaccccatctcttaaaaaaaattagctgggcatggtggcacgcatccataattccatcaatttgaaatgctgaggtgggagtgttgcttgagcccagtattttgaggctgcagtgagctatgatgacaccattgcccagcctgggcaaaaaagtgagactctgtctcttaaaaaacaaaacaacacaaaaaagttcactgcatggatcatgaatggagggaggagaaagaagatatgagacattgtgggtgcaattaggaaaatctgaacgtggactcaatgtcagatgaaattatagaatgattacacatttctttttcatttttatgtttttagagacagggttgctacgttgctcaagttggacttaaactcctgtgctcaagtgatcctcccacctcagcctcccaaatagctgggactaaaagcactcgccatggaacatggctcaatcataaattttcttatatcatgatagtattacaggtatgtcaaagaatctcctcatccttagagaggcgaactgaagttgttagagataaattgtcatgatatctataacttactctgaagtgaatatgcaaaatgttaactgatgaatttaagccaagagcacagttgttcactatacttaactttcaacttttctgtaggatttaaatatttcaaaataaaaatcagagagaaaaaagagcccaaaagaaaaataaaatatatagtcactcctttttattgtttttctttttcaccaaaaattttaccaaatttaatttttttttttttttctgaggcagagtttcactcttgttgcccaggctggagtgcaatggcgcaatctcggctcaccacaacctccagctcccaggttcaagcaattatcctacctcagtctcccgagtagctgggattacaggcatgcgccaccacacccggctaattttgtatttttagaagagatggggtttctccatgttggccaggctggtcttgaactcccgacctcaggtgatccaccctcttcagcctcccaaagtgctgggattgagccaccaagcccgccccaaacttaattcttttttttttttttttttttttttgagatggagtcttgctttgtcacccaggctggagtgcagtggcatgatctcggttcactgcaagctccgcctcccaggttcacgcctttctcctgtctcagcctcccgagtagctgggactataggcgcccgccaccacgcctagctaattttttgtatttttagtagagacggggtttcacagtgttagccaggatggtctcgatctcctgacctcgtgatcctcccgcctcggcctcccaaagtgctgggattacaggcgtgagccaccatgcccagcctcccaaacttaattctttaaacattcatttttggggctgggcgcggtggctcatgcctgtatcccagcactttgggaggccgaggtgggcggatcacctgaggtcaggagttcgagaccaacttggccaacatggtgaaaccccgtctctagtaaaaatacaaaaattagctgggtgtggtggcaggcgcctgtaattccagctacttgggaggctgaggaacaagaattgcttgaacctgggaggtggaggttgcagtgagccgagatgatgccactgcactccagcctgggcgacagagtgagattctgtctcaaaaaaaaaaaattcatttttggctcacggcagcctcaacctcctgggctcaagtgatgcttctgcctcaacctcccaagtagttgggactataggcatgcaccatcatgcctggccaatttttaaaaaaatatattaaaaaaaaattattactacttttctgtaagtcaggaattatgtcaaaataaagacttaaaagttttaaaaagttgttcacacctcatatccattaggatgaccactataaaaaaacaacaaaacaaacaaacaaaaagtaggccggatatggtggttcacatctataatctcatgtccataatcccagcactttgggaggctgaggtgggaggattgcttgagcccaggagtttgagaccagcctgggaaacatagtaagattctgtctctacaaataatttttttaaaaaactggccaggcatggtggtgcatgcctatagtcccagctacttgggaggctgaggcagaagcattgcttgagcccaggaggtggagccatgatggtgcccctgaactccagcctaggtgacagagcaaaatcctgtctcaaaaaacaaaacaaacaaaaaaccagaaaataacaagctttagcaaggatgtggagaaactataacccttgtgcactgttggtgggaatgaaaagtggtgcaactgctatgttcctcagaaaattgtcaatagaatgatctagcaattccacttctgggaatatagccaaagaactgaaagcagagtctcagacatttgcacacccatgttcatagcagcattatacacaatagacaagagatggaagcaaaccaagtatcccttgataggtgaatagacaaacaaaatgtggtatatccataaaatggcacactattcagccttcaaaatgaaggaaatcaggtcacatgttataacacacatgaaccttaaggacacgatgccaaatgaaataagcaagtgataaagggctaatgctgtatgattctacttatgaggtacttagaatagtttaattcatagagacagaaagtagaatggtagctgccagggcctgggggtaaaggagaaaagggagttgtggtttagtgggtatagagtttcagatttgtaagataaaaaagttctggagatctgtttcgtaataatgtgaataatcgtaatattactgaactagatggtaagtgttatttgtgtttattattttagaaccacaattttaaaaaattgttcaccaagtacccagtagcaggggaatgaccaaataaatagaggacatcgacagcacggaacactccacagcacagagagtgagggccatctctactgctggtgcctgggacctccaggatgtcacaggtacagaatggcaaaccagtatgctgcctctggtgtgagatgggggagaaaaatatttcttgggtcagcttgttcaggtcctcgatcccttgtccaaactctttaaatcaagtgtattttagaattcagaaggttccaacgtgagaaatactgtacacatgccacataggatcttatatcccacgggatctgggtcggtgcctcctcttcaaacaccttaatatgccccccaaaaaagtataaagactcacactaggataaaaaatataattagcctcgaaaataattttgagttttgggtgggttccgtggcttaatgagtttacgccaaacttttttttttttttttttttttgagacggagtcttgctctgtcgcccaggctggaatgcagtggcgcgatctcggctcactgcgagctccgcctcctgggttcacgccattctcctgcctcaacctcccgagtagctgggactacaggcacccgccaccatgcccggctaattttttgtatttttagtagagacggggtttcaccatgttagccaggatggtctcgatctcctgacctcgtgatccgcctgcctcggcctcccaaagtactgggattacacgcgttggccaccgcgcccggcctacgccaaacatttctttaagacgtttggctgggccaaagttagctgagttatttcagttgattgttcatagtcagtaacagatcaaactcattcgtctctgtccccccttctcactactgcacttaactagtctaaaaaataataatagataaaaataggccgggcacggtggctcacgcctataatcccagcactttgggaggccaaggtgggtggatcacctgtggtcaggagttcaagaccagcctggccgacatggtgaaaccctgtctctttcaaaaaatacaaaaattagccgggtgtggtggcatgcacctgtactcacagctactcaggaagctgaggtgggagaatcacttgaacctggtaggcggaggttgcagtgagcagggatcatgccactgcactcccgcccgggcgacagagagagactccatctcaaaataaaaaaaaattaaaaaaaaatttttttttcttttgtaaacggagtcttgctctgtcgcgcaagctggactgtagtgggaccatcttggcttggctcggctcactgcagcttcaacctccaggctcaagcaatcctctcacctcagcctcccaagtagtggggactacaggtgtgtgccactgtgcccagctaatatttgtattttttgtagagatagggttttgccatgttgcctaggctaatctcaaactccaggactgaactgatctgcccaccccagtctcccaaggtgctagggttataggtgtgagccaccctgcccagccccaaaagttttttggtttttgtttgtttttgagagatggacccttgctatggtgtccaggctgcagtgcagtgacatgatcccactactcaacagcatgggagttttgacctggtccatttccatcctgggccggttcacacctctttttaggcaaccctgctccaggaaggtcaccatattgatgccaaatttagtgtggataccctgttggcatggcacactgcaacccagaacttctgggctcaagcaatcctccggcctattctcccaagtagctgagactataggtttgagccaccacgccctgctcaaaaaactttttaactgtgagaatggatgctgaatgttatcacatgcctgctcaccatgtctgcagatatgctatatagacacgtatgcagatatgttgggttgtcatgaattgatggaatgccatgattccctggcatgtaactagtaagacagattccctagcatgaaaccaattttttttttttgagacaaggtcttgctgtgtcacccaggctggagtgcagtggcacactcacaactcatggctcactgtagccttgacctccccaggtttaagtgatcctcccacctcggcctccccagaagctgagactacaggcatgcctggctaatttatgttttgttttgtttgtttgtttttctttttttttttgagacggagtctcactctgtcgcccaggctggtgtgcagtggtgcgatctcggctcactgcaacctccgcctcccaggttcaagcggtacttctgcctcagcctcccaagtagctgggattacaggcatgcaccacaacacctggctaatttttgtatttttttttgacctctgaactttttattggcctcctgctccccaaaggataccctgcttctggtggcttaatgtctcagaactttggtgtcattggtctcagacaccactttgccatccattatctggcaggtggtggtcttttggatggtttgcatggagttgctgctgtccagggcatcaccaagactgaagtcctcgccatcttccagcaggcggcagtaggtggtgatcttagcctccagcttgaccttaacgttcaccagggcgtcctactcctaggcctggcactgtccctctgcccggatttgtgccacctctgactccaggtgcagcaggatcccattgagctgctccatctacagggcatagaaggcctccacctccctgaggctgttctacaagctggccttcagatttctcaaggagtccaggttgatctccaaggactggacgtacgtctcaactccgtgattgtcatctcagcagttccaacctcagtggactgcatggtgaccactgtggtgctctcctcaatctgctgagaccagtacttgtccagctcctgtcgtttcttccgagccagctcatcatattgagcctggatgtctgccacgatcttggcaaggtcctgagatttgggggcatctacctccacagtcaacccagagctggcaatctggtcttgtaggccttttacttcctcttcatggttcttcttcatgaagagcagctcctccttgagagcttcgatctctgtctccagctacagctgagggacattggtgtcatcaatcactttgcgaagcccatgtatgtcgctctccacagactagtgcatgggcagttctgtctcatacttgactctaaagtcatcagcagcaagacgggcattgtcgatctacagaaagatacgggcgttgtccacagtatttgcaaagatctgagccctcaggtcctcgatggtcttgaagtaatgcctccagtctctgatctgggtcccttcttctccaagtgcttctggattttgctctccagcttccggttctcggtctccaggctcctcgctctgtccaggtaggaggccaggcggtcattcaggctttgtatggtctccttctcattctggatgcttcccattcctgccagatccccagccatccccgcggccaggcccccagaccccatgcagccctggaagctggtggagcgggacacgaagatccaggaaccagagccctcggtgcctgcatagacgctggccacgctgctgaccagccaggcgccatagctgggagcctggacagagcccagggaccagtagttggtggagaaggtagagcgagtggtgaagctcatgctgtccggggaggagagcaagaggacaggactcaggctttgctgatgacctaatttttgtatttttagtagagacggggtttcgccatgttggccaggctggtctccaactctggacctcaggtgatccacccgcctcagcctcccaaagtgctaggattacaggcatgagccaccgtgcccagctttgtttgttttttgctttttgaggcagaatctcactctctcatccagtctggagtgcagtgacgcgatctcagctcactacaacctccacctcccaggctcaagcgattcttgagcctcaccctcctgagtagctagaattacaggtgtgcaccactacgcccagctaatttttgtatttttagtagagatgggtttttgccatgttggccacactggtcttgaactcctggcctcaagtgatctgccggccttgggcacccattgtgctgggattacatgcatgagccactgtgaccagctctaatttttgtattttttgtaaacatggggtttcgtcacgttgcccaggctggtctcgaactcttgggctcaaacaatctgcccaccttggccttgcaaaacgctgggattataggtgtgagccactgtgctcagcctttttttttttttttttacgagaaaagaggtctcttactttgtcatccaagcgagagtgcagtggcatgatcatggctcactgcagcctcaacctctcaagctcaagctatcctccctcctcagcctcccaagtagctgggactataggccacgccaccatgcccagctaattaaaaaaaatttttttttctttttctgaaactgctctgaaaaaatttaaatggcattggagtcttttcataaaaggcacacctaccctggaaaacatctgggctttgtgttttgtggggaatacaactttctctctcttttggggataaagtgctattaattttttaaaaataaaatcatcaattgtatccaaacttttaaagtaacagacattgagttcagctaagcagtcttttataattcacagatggaatgaaaactaagggagggacgaggtgacccatggaggttgtataaaaaggacagagcctttgggctcttcagactataagggtccaggaggagaggagaaaccacctcagaagcatacaaggttaaagcatacaaggtgggtgtagggtcaggggagccaaagtaagtgtgcaatgaaaagttattaacaaaagtcaaaaaaagaaaatgcagtctggccatccaattcctaaaccatgtacagagtacacagaaagagcacaggaggcttcctgcagcagggcagtacagctctctgcccttcaggaaaactgagattcctccacctgggaaacagcaagggacaattagggaaagctctccagaggaggaggcatctcaggtgggccaaagaagaaaaatttccacaggacagaaaaggcagagaagaggccaggcatggtggctcacgtctgtaatccgaacactttgggaggccaaggcaggcggatcacctgaggtcaggagttggagaccagcctggccaacatggcaaaaccccgcctctactaaaaatacaaaaattagccgggtttggtggcacacgtctgtaatcccagctactcaggaggctgaggcaggagaatcacttgaacccgggaggcagaggttgcagtgagccgagattgccccactgcacttcagcctgggggacagggcgagactccatctcaaaacaaacaaacaaaaggctgggcgtggtgtggctcacacctgtcatcccagcactttgggaggccaaggagggcaaatcacaaggtcaggagttcgagatcagcctggccaacatggtgaaaccctgtctctactaaaaatacaaaaaattagccgggcgtggtggcgcacacctgtagtcccagctactcgagaggctgaggcaggagaattgcttgaacccggaggcagaggttgcagtgagccgagatcacaccactgcactccagcctgggtgacagagtgagattccgtctcaaaaaaaaaaaaaaaaaaagaaatttatgttctttgtaaaataattcagacaatgcagtaaacagaagaaattcagcctccctctccctttgccctttgctgagtccccacggtgcagcaagatccttccagatcttcatggttgggatcatcttccaccaggtcctgaggtttttcactccctatcagtagacacaccacactgcccagtttgcaagtagctccattggataacacagaaaggctctgtcctgcaccatgtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgagacggagtttcattcttgttgcccaggctggaatgcagtggcgcaatctcggctcactgcaacctccgcctcccgggttcaagcaattctcctgcttcagcctcctgagtagctgggattacaggcatgtgctaccacgcccagctaattttgtatttttagtagagacagggtattgccatgtgggtcaggctggtctccaactcctgacctcaagttatccgccctccttggcctcccgaagtgctggaattataggagtgagccaccaagcctggcctctttctaggctcactgcaacctccgcctcctgggttcaagtgattctcctgcctcagcctcccaagtaactgggattacaggcatgtgccaccacgccccgctagtttttgtatttttagcagagacggagtttcactatgttggccaggctggtctcgaactactaatctcaggtgatccacccgcctcggcctcccaaagttctaggattacaggcgtgagccactacatccagcctcttttttgtttttttgaaacagggtcttgctctgtcacccaggctggaatgcagtggcacaatctcggctcactgcaacctccgcatcctgtgttcaagcaactctcctgcctcagcctcccaagtagctgggattacaggcgcccaccactacacccagctaatttttttttttttttttagtagagacagggtttcaccatgttggccaggctagtctcaaactcctggcctcaagtgatccacctgccttggcctcccaaagtgctgggattacaggtgtgagccaccgtgactggcctctatttcttatttatacatacacacacacacccccctgtgaaatgactctgggctcttccaataatgttgccactctcccgctccccttcccaatggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagcgaaaggctgcctacactgtcatcttcagaaagagtggtatgacactaaatcaagaagggctgagagggtgagcccaggggatcccataggctccacagcctctggccatcctctcctatacaggtcctaagtcccctgcagggggccctcagctcctctaccctacccactgtcctgtatgttatcttaatgcttattaaaggcctcagctgaatttccctggtgaactgaaagaattctgctgctcctggacacatctgcaccaagccaccactgggtcacattctccaaaactccttttggagacagaaggcacttaaaccatacatattttgcttgatagttcctaattaaaaaaatagagagagataaagagaaagagagagagagagaactacaactaagccttgaagacaaaatgattgaacagaatcagagctagaatggaacacctcaggcttggagtcccatgacaaccttgctggggaccacgagtggccctcagtccttctcaggctcatgccacctatgtgaaataagggtggtgacacccacctccttgagtgcagagcagtgcagacaacagggcaaatggtgtattgatctgctatctgtgtacataaatttattcatttaagccatgggtattgtttgaatatgtgaaaaccatgtcaggtgctagggataagagacagattccaacccagtggaaaagacagataagccagtggttcctcacactgtgccaagtgctgggatggggtcacgaaggaggccataagaaaccccagaggggccacagagctcactgggagggccagaggctaacacctgagggatgagaggtgtgagccagaaggtgatgcatacacagcaataattactgacggaggggaggaatggtaagggaggggaggagagaaaggaggaaagaaaagagaaaagaaaagagagagaaaaggaaaagaaaaggaagagaagagagggaagagaagaggaggcaaagcccaagaaacaggatcactgaatgaaaaatgaactctaagacccccttctgtctctcacacttgttgactaagtcatagccacaaggagtaggggaggctctgaggtgagcaggagaccagccactgtcaccgccagtacctttactagcagagccaggattacctttgttattcttcttacaaacagctctagtgaactcacctgaagtaatcgcaggacgcagccagcaggatgcgatgggcctcgatgtgtctgccctccaccaccagcacaacatcgaagaggattccgctgtcccggagagccagcagccctcggagcagagcctgggagtgctgtgcgctgcggtaggtgttgttcacgcagtgtgggtgtgagggctgtgcaggcaacttgcagagctgggtgaactcctgctcctctgccatcctgacagccacaagatcccttacaactgtggcctgacagttggcaaaacaggggacaggggtgagcaggcaggcatcagccccaccacacacagactggccagctctgttgctccccttgctcctgtgcctccctcaggctcacctgttttccctctatttccaaatcccctaattccttctcccctcccacctctagtccaacttcctgatggccttcttcctgatgacctgtgtgccatcatgcccaagactcttcatctcattgtatcttcttcagcggcaaagtcaaacagaagggttttgggaaacagactgacctgggttggagcccaactccacagggacttacaacatgaccaaactgagcctcgagctccccaattttaaaaagagagataaaagtacctaccccattggggtattctaaaattggtaaaacaatgaacatgaagcataagcacacaccaggttctcaagagctcttcctccctcccattgaatgaacaaaattgggttcttcctcatagtaatggatgcataaaaatggcaagacctgagtagtggtcaggagacacacagccaggagtctgggaggtgggtgccaagggggtggcatttccagggcctactttcctttactgaaattctgagagtcaagcacagtaactgtgattgaacctgatgcatttaaattcatctgcattgccttttaaattaaagattatcttctaataattgagtcagtacgttcaaaaaccgcaaactgatttgaattggagcctctaaaacctaatcagtaaaatgaacctactgcaaatgcacttttgccatggagcaaccaaaagtgactgtggatagccagctgttcaggtcagggagtggccagtcccacactgtgaggcatggccaagctgcaggctctgtaggcacagcacagtcagctacaagatgtgaacatctgtcttctccacctcacttcatcctactttcctctccccaaaatatgtttattctccaattacctccagtcatgcatcacttaatgttggggatacattctgagacttatatcgctggaggcaatttcctcagtgtgtgaacatcaaagggtacacctacacaaacctaggtggtagagactactacacatctaggccataaggtacagccaattgctcctaagctacatacttgtacagcatgttactgtagttctgaatgaaaaaaacacactgtttttcctctcctcttataccacaacaacaaacacaggagacttctgtgaccaaatgtgtgagggtttttccccattaacaagcaagcaatcaattctgccacagataccagctgggtgtcttctaattcagcagtccccaatctttttggcactagggaccactttcttggaagacaatttttccacggggtcggggaatggtttcgggatcaaactgttccacctcagattatcaggcattagctagattctctttcggagcacacaatctggacccctcacatgcatggttcacaacagggtttgtgctcctatgagaatctgatgccacctctgatctgacaggaggtggagctcaggtggtaatgctggatcaccctccactcacctcctgttgtgccacctggttcctaaccagccacagactgatacaggtctgaggcctgggggttgcggacccctgctctaattcaactctaacactacctggagacagtgtctgatcccacaggttgagggctgagtctcccaggttgtttcacctgtgcttctgaccaataggctataaattgggttcccaagatccccttcttgggttcaactaatttgttagagcgactcacagaactcaggaaaatactcatgtctactggtttgttataaagggtattgcaaaggatacagatgaagagatgcatggggccagacatgtgggaagtggtgcagagcttccaggccctctccaggaacatcactctttaggagcctccatgtgttcaactatccagaagttttccaaacccagtcattcagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgccaaaaagaagaggtctctctcttcactactgaggctcagggccacccccaaccccatcccctggatgctctactgcttcccatcaaacacactcagttatctgtgcctgcccctgagtctgcctccaggacctgggacctctatccagccacccacccattcctttccccctcctgggctggctcatctttctcaccaaggccccagagatggccacagccaaggtgtataccccatgaccacctctcacttaggattctcttgcctggaaactctgctctatgataattctcccttttctgacctctctctttcatcccacacaccctgctcgagcccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatcctccccaggctgctctccttcaagccttacctactcagccccatcagcagtccttagtccaaaagggatacctgtcatcccctgaacacctttagtcacccatctaggccattctgtctctcatagtcccatattggtcaaggtctagctcgattacttctccctctatcattgtacagagaacatgacaaatatgccccaccattcaaacctgcccttttttttttttttagacggagtctcgctctgtcacccaggctagagtgcagtggtgtgatcttggctcactgcaacctctgcctctcaggttcaagtgattctcctgcctcagcctccccagtagctgggattacaggcgtgcaccaccacacccagctaattttcttgcatttttagcagaaatggggtttcaccatgttggtcaggctggtctcgcattcctgacctcaggtgatccatctgccttgacctcccaaagtgctgggattacaggcatgagccaccgcgcccggcccaaacctgcctatttacccacgacaaggagattccggcttcttgaggggtgaggttttatctcacaaacatctcaaaagcccccatggctggctgtaccacttgctaatgacagactctgggcacttgtctcatatacccacgcctcagctttctcatcaccaccatgaccaccgcagagtcaagagggcctccttctctgagggtgacctccacaactaccccaatagacatcaagcccccaggtggatcctcaccttccgtgagcatagtagtgcctctgctctcttgggaagggataaatggcagctactccctaaacccatactgcaaaaacaagtacggtaaaacagaaagacatcttccatgggcaggcaaagcacatttaccaagtccaatttaagaaacttagctaggggctaagggggatatgctgaaaaatgaatcaattctctgctgggaaggagcacagcacagggtgcaacatttaaaacatttaaaaccacatctatacggttttaaatcaccaaaacgtccaccctcaggagaacagatgtcatggcacagtgatctgacagaacattaggcaacagtcaaaatgcgcaaagtggccgggcgcagtggctcacgcctgtaatcccaacacttcgggaggctgaggcggatgaatcacgaggtcaggagttcaagaccagcctggccaacatagtgaaaccccatctctactaaaaatacaaaaaaattagccgggcatggtggtaggtgcctataatcccagctacttgggaggctgaggcaggagaatcacgccactgcattccagcctgcatgacagtgcgagactccgtctcaaaaacaaaaaaacaaacaaaaaaacaatgtgcaaagtaggctgggcacagtggctcatgcctgtaatcccagcactttgggaggccaacgtgggaggatcacctgaggtcaggagttcaagaccagcctggccaacatgaggaagccccatctctactaaaaatacaaaaattagtggggcgtggtggcgcatgcctgttatcccagctactgggaaggctgaggaagggggaagctgaggcaggagaatcgattgaacccaggaggtggaggttgcagtgagccaagattgtgccattgcactccagcctgggcgacagagccagactttgccccccccccaaaaaaaaaagtgcaaagtaggctgggcatggtggctcatgcctgtaatcccagtgccttgggaggtccaggtaggtggagttcaagaccaccttgggcaatatagcgcgaccctttctctacaaaaaatttaaaaattaactaggcatggtggtgtacacctgtagtcctggctatctggggtgagacagcttggggttcactgcagtctcaagctcccaggttcaagtgatcctcccacctcagcttcctcagaagctggaacaacaggagctcaccactgcgcccggctaatttttcaaattttctttgtagagaagaggtttcactatatggtgtaggctagagtgcagtggtagggtcttggctcactgcagccttcatctcctgggttcaagcgattctcctacctcagcctcccgagtagctgggattacaagcacgtgtcaccacacccagctaatttttgtatttttagtagagacggggtttcaccatgttggccaggctagtctctcctgacctcaggtgatctgccagccttggcctcccaaagtgctgggattacaggcatgagccaccgcgcccgcccccagtctcatatccccaattttagtcatcacaagccaagttccccgttttgtactgttcgaagtttcagtggggagaagaaaggaagcttaatgtgccacatagctacaaactgaaggatacaagatgaatttttatgaagtgatggatggcagagtcaaaatcatttcagaggaactttcagttcggtacgattttactgagtagataccctcagccttctgtagggcccccgaacgagcagtatcccctcaaagaaactcaatccttggcagcatgaagcaaggtcggccacaaaggcaaagggggcggctgcggtagaggagagggagtgggtgctgattcccagcggggcagccttccaaagggtgcgctctggaagaatctcccagggagccgtcttggaggcactcggccccgcggagggccggagcgagggcgcccagtgaggagcccaggcggaaggtggcggtgccccgctgcccgccccagatccactcggctcggcccgcaccggatctaaaatggtcagaactggcagccgacgcttcgcgctctggtgattttgcactgacagcgcgatctccggctcctctcaggaaaccgggagagctggcaaggctgggctcctacggctgcagtccccgggcccgatcgagggaactgaggctcgtcaggccggccccaaatcgcccgcctgttgcaaggccgcccgctccagcgcggagggtcgcggccaggaaggccgcattcggacctgccgcaggcaacagggcccgcccgggtgccaggaggccggcgcgccagcagccgcgctgaggaggcctcgcaccctggcccctggccgagcgccagatcccggcccctacgcgcccgcgcccggggatcccgccggccgcgtccccgccacgtcaggccgcgggctctcctcaggtcgccgcccccgagcctccggcccgcgcccgcccccgcgcccctcggactccgcgccgctagcttgtccccggcccagcgatgcctgcttgccgcccgacccccgcgttcgctgccgcccggcccgttcggctcacgcctcgcagctgacctggtgccgccgccagccgaggccgcactcgcagctggagggaggcgggaggcgggaggcgggaggcgcgaggcgggaggctgggcgagaggagccggcggggcgggggcctgggccgtcacgtgggtgcgccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaaggtaagcattcttaccaaggttaactgtcccatatcactgcctgtagtactcagctgagagtggaaggtaaaaacttcttgtcccttcctttccaaattcaaattagcagaagaaaacattgtgtctggattgtgactcttgcttaaatttggttgaggggtaactgtttgttattgatcctttcctcccaggcacagctacctctttcctgtttgttttatttgtgtcctgagagcttggctttatgaccagtgagaatattctccctgatctctgaatagccagtgggtgcaagtgacagcttgctttaggacagcttgcgttagggttgcaagtaacagcttgcattattacaaactcctctgtcccggtcagaaaaagagaaagtttggtttttgtttgtttgtttgttttttgttttgttttaatagtcttgctctttcgcccaggctggagtgcagtggcatggtggcatgatcttggctcactgcaactgctgcatcctgggctcaactgattcttctgcctcagcctcctgagtagctgggactacaggcacacactaccacgtccaggtaattttttttgtatttttagtaaagagggggattcatcatgttgcgcagggtgattttttttttttttttttaattcttttctgagacggagtcttgctctgtcacccaggctggagtgcaatggcgggatctcggctcagcctcctgagtagctgggattacaggcacctgccactacgccagctaatttctgtatttttagtagagacagggtttcaccatgttagtcaggctggtctcgaactcctgacctcgggtgatctgcccacctcggcctcccaaagtgctgggattacaggcatgagccaccgtggctggcctcttttatttttaagatacagggtctcacccaagctggtcaggaactcctggcctcagtccacctgtctcagcctcccaaagtgctaggattacaggcatgagggaccacgcccggccaaagagaaggttctgaaccttctctttttctgaccatgacagaggagtttgtaagtgggccaagtctataaggggtttttgttgtctcagtattcattggtgtgatagatgagccagtccatgactggagacgtgacagtgttctgtacaagatgacatccttagtcacctgtgtcaacaaaggtgccttctggctaggcacggtggctcacgcctataatcctagcactttaggaggctgagccaggcaaatcacgaggtcaggagttagagaccagcctgaccaacatggtgaaaccctgtctctactaaaaatacaaaaaaattagccaggtgtggtggcgcatgcctgtaatcctagctattcgggaggctgaggcaggagaatgggttgaatctaggaggcagaggttgcagtgagccaagatcgcgccactgtactctagcctgggtgacagagcgagactccgtctcaaaaaaaaaaaaaaaacccaaaggtgccttctttcttttgactgtctttgcaaggggtctggatttgagagtgctgaatctttgtgcaccctctttggagtgtgtctttctctctctctctctctcttttttaagagacagagtctcacccagactgatcaggaactcctggcctcaggtggtcctcccaccttgacttcccagagtgctgagattacaggcatgagccattgtgcccagccttgaggatgtctcttttgtccatggttaagtcataaaatgcttattggtcttggttctgagttgcttggtaggtacctttggtttacaagaagaaaagtggtgggtgggcagggtggtagtagggaagagtgttcagtactgccaggaatatgtactatctgttctggctgaaaactgacaatgagatatttgaaaggattttttttttttttacagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatatatgtatgtatatatacgtatttacgtgtatatatgtatgcatacatatatatatatatagagagagagagaaaccagtgagtttgtattactgtgttttactgactcacgactaccattttggaatgaaagctataagatctttgtgtttttacgtttatgtgtttatatttgtgtatatctatgtatgtatgtttgaatattatatataatattttttctatctccatattcagtattactaactgaatttttttttttttttgagatggagtctcactctgtcaccaggctggagtgcagtggcatgatctcggctcactgcaacctccgcctcccaggttcaaacaattctcctgcctcagtctcctgagtagctgggactacaggtgcgagccaccatgcccagctaatttttgtatttttagtagagacgaggtttcaccatgttggccagcatggcctctatctcttgacctagtgatccacccacctcggcctcccaaagtcctgggattacaggcatgagtcaccacgcccagcctaaattttttaaatcccttaaaggagttatattcaaattgtaccctcctttgaagatgtctcttttgtctgtggtgtcttaaaaggattattggtcttagagggaggtaaataagcattcatacaagctaaatattaccaaaaatttaagaaaaatagaaactaatccaactgctttttagtttacatgatctggaatattctttagtaaataaagctagtttgaaaattgatggactacgccgggtgcagtggctcaggcctgtagtcccagcactttgggaggccaaggcgggcggatcacgaggtcaggagatcaagaccatcctgactaacacggtgaaaccctgtctctactaaaaatacaaaaaattagccaggtgtggcagcatgggcctgtagtccccagctacttgggaggctgaggcaggagaatggcgtgaacccaggaggcggagcttgcagtgagctgagatcacgccactgtactccagcctgggcaacaaagcaagactccgtttcaaaaaagaaaattgatggactagtcaaacaagttttatgttatcactactgaatggtaaagataataaaactatcaatccaacctaagagcaaaatgtgcaataaaaatgaattgcggctgggctcacccctgtagtcccagcagtttgggaggccgaggcgggcggatcacctgaggtcaggagtttaagaccagcctggccaatatggtgaaacctggtctctactaaaaataaaaagtaaggccaggtgtggtggcgggacctacctgtaatcccagctacttgggaggctggggcaggagaatcgcttgaacctgggaggtggaggttgcagtgagccgagatcgtgccactgcactccagcctgggagacagtgcgagactccatctcaaaaaaaaaaaaaaaaattgggcacggtggtacaagcctgtaatcccagctacttgggagtctgaggcaggagaattgcttcaacctgggaggcggaggttgcaatgagccaagatcgtgctgctgcactccagcccaggcaacagagtgagactttgtctcaaaaaaaaaatgaattgcatggcttggcgcggtggcccatgcctgtaatccagcactttgggagactgaggcaggtggatatttgaggtcaggagttcgagaccagcctagccaacatggtgaaaccccatctctactaaaaatacaaaaaattagccaagtatggtggcgtgcgcctgtaatcccagttacctgggaggctgaggcagaattgcttgaacccaggagctggaggttgcaatgagccaagattgcaccactgcactccagcctgggcaacagagtgagactccatctcaaaaaaaaaaaaaaaagaaacaataaccactccctccctacctccacatacataagtgattacaggctccaggccaaacacacagaggagttacatctggctggtgctaggatggaaggtggggcaggtcaccacctcccagggactgagtgccaaagcaaggaggaagattggaggtgaggctgtatggagacagccacaggctcacagagcttgtgctgagctctctagggggaagcttgatctgcctgggaagcttccagctcctacctcctgcagagcccagaatggtgtccaggaaatatgtggccattgagtggaaccagccttggcatggtagcctgcaggaacccgcaggctagagacatggccacatgagcagtgaggatctcccccgagatgaggatccccagaacatagtgtgggatgcaggtctggcctctgcataccctcggcttcctccatcacttattctcagacatctaaaccactaacatccagactggggatcccaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttactgtgatgataaactcctggcaaagttccaggcctctctctgtctgtgtctgtgaattatgtgtctgtgtctccatcaaccatagtgcagaagggggagggttgtcctaagtatcctattaacatgtttgtttgtttgtttgtttgagacagagtttcgctcttgttgcccaggctgcagtgcaatggcataatctcagctcactgcaacctccacctcctgggttcaagtgattctcgtgcctcagcctcctgagtagctgggattacaggcacacaccaccatgcctggctacttttgtatttttagtagagacggggtttcactatgttggccaagctggtctcgaactcctgacctcaggtgatccacctgcctcagcttcccaaagtgctgggattataggcgtgagccaccatgcccagccagaacacaggactttcaaaacttaaacctggggctgggcacggtggctcacacctgtaatcccagcactttgggaggccgaggcaggcggatcacctgtcaggagttcaagaccagcctgggcaacatggtgaaaccccatctttactaaaaataaaataaaataaaatacaaaaatgagtcgggcgtggtggcgcactgtagtcccagctactggggaggctgaggcacgagaatcacttgaaccccggatggcggggactgcagtaagcgatcacgccactgcactcaagcctggcagacctagcgagactctgtctcaaaaaaaaagaaaacaaggctgggcgtggtggctcacgcctgtaatcccaacactttgggaggccaaggcgggtggatcgccaggtcaggagattgagaacatcctggccaacatggtgaaaccctgtctccaccaaaaatacaaaaattagccagatgtggtgccaggtgcttgtagtcccagctactcaggaggctgaggcaggagaatcacttgaacctgagaggcggaggatgcagtgagctgagattgcgccactgcactccagcttgggcgacagagtgagactctgtctcaaaaaaaaaaaaaaaaaaaaaaaaaaaaaaaccaagggccgggcgcggtggctcacgcctgtaatcccagcaatttgggaggccgaggcaggcggatcatgaggtcaggagatcgagaccatcctggctaacacggtgaaaccctgtctctactaaaaatacaaaaaaattagctgggcgtggtggcgggcgcctgtagtcccagctacttgggaggctgaggcaggagaatggcgtgaacccgggaggcggagcttgcagtgagccaagattgtgccactgcactccagcctgggcaacagagcaagactccatctcaaaaaacaaacaaacaaacaacaacaacaaaataaaacaaggaaaaaaacactaaaaccttggatgtcctgggcaaccccggtcaagatgatcactctagatagagtttttaaaaattagttttcagcctggccaagatggtgaaaccctgtctctactaaggatacaaaaaattagctgggcttcgtagcaggcacctgtaatcccagctacttgggaggctgaggcaggagaatcacttgaacccgggaggcagaggttgcagtgagccgagatgtcaccacagcactccagtctgggcaacagggcgagactccatctcaaaaaaaaaaaattagttttgccaccgggcacggtggctcatgcctgtaatcccagcactttgggaggccgaggtaggtggatcacctgaggtcaggagttcgagaccagcctggccaacgtggtgaaaccctgtctctactaaaaatacaaaaattagccaggcatggtggggtacgcttgtaatcccagctactggggaagctgaggtgggagaattgcgtgaacccgggagacagaggttgcagtgagccgagatggcaccactgcactccagcctggccaacaagggctaaattctatcccccccccctcaaaaaaaacaataacgattttgggagtattagagcagaaaacgtttgaaaacatgaacagctctcacatcaacacaagacatgaaactctgttggcaagagaggcctctttggggagagtgctcactcctctcccacccactctctaccaccttcaacctcctgtctggggcacagtaacaaggggtgtaaggggtgtacagtgcctagcaggggcctggcacttaggcttcagtaggtgccagtccacagtctcctgaggcccatgttggttggtgtccacctggtgcttattgaccacttgggctccagattttcctcacgtcacctccctccccagggtagcagataaaggccccatagttccaaggaggcagaacttttacattcctaaaagcattctcaggcccccataacccctcatcccaccttcagctcgctcaccttcacctatcaaattcgtttgacatctggcctccagcaactagctaggctgagttctccatgaaggggacgtggctgctggtcaaaagggaaagcccatgtctaaaaattaattaacgtggtttaggggcctcacattcccaacccccaaatacagccattgtgagatgtgagattcaaaaaatcgaagagtgaagcggtgatgagagtccatctggtcgctcttcggatgcggcgctagcaggcagttgcatgaaagcagatcccagatcacgttgcactggcacacagtaggtacccacacatatttgataaataaacactctctccctagcattactatagatagctggcagcttggcctggcatcccggaggggtctggatctcagggactagataaggccagcacactgaagagttgcagaaaatgcaggcggtcaggcgcaggtctgctgcgggagcacctgccgtgtccgacagctgcactggaagaggggcgtgtgtctcccagccgggcggaaccgagaccgcttcgtccccggcggggaacttcatttcccacaagcctgtgcgcgagactccatttcccacaagccctccttcacttccggctcggccgaggcactgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatgtgagtagtggtcggggcagggggctggattgtgggaccttcctccttagcgtggcgggcgaggccagggccggacccgtgagaaacctacggcgccgggagacagaaggcgccggggacttgcgtgggtcccagggctcgggcccccccgtctgtcccctccgttcccgacatggactgctcgtttgctttcctggggccgagctctgcaaaccaacgagccctggcttatgaatcatcgtcttgagctttctcattcgtcatttgtgtgctttgggtgcagactttcccccgctttttgaaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtgtgagcaataaagctgtttatttcacctgggtgcaggtgggctgagtccgaaaagagagtcagcgaagggagataggggtggggtcgttttataggatttgggaaggtaatggaaaattagtcaattgttctctggtgggcagggatggatctcacaaagtacattctcaagggtggggagaattacaaagaaccttcttaagggtgggggagattacaaagtacattgatcagttagggtggggcaggaacaaatcacaatggtggaatgtcatcagttacggctgtttttacttcttttgtggatcttcagttacttcaggccatctggatgtatacgtgcaagtcacaggggatgcgatggcctggcctgggctcagaggcctgacagtttttaactgagcttattggcgtgttgtgctcgccacagatttgcctgagacacagcccctttcctgagggatggtaaaggaaccgtcacagcgcagtcttgtcagtctgtaatgtgtatactgcaggggtttcttgcgaagcggcggttaacttgagcagaccaggggcagtctagtgagtaggtgacgaataaattgagtcctagaaagacaagtaggagtgtgaatagccaccattccaagctgaggagttaggaaacatgagcatttactgcgtggagggaggatcttgtaggctgagagttctggggctcgaggagtaagagagcccaggagatgatggaatgagggtgagcaggtactagcactttagtgggggtgttgtgccaaggaattgagcctgtgtttggcatgtggcattctttggagtagtgaaatgccagtgttgggaatatgcctagagtccctgtccctggagatggatgcagggcagagaagagagaccagttaagctattaagagagtttgaacatttggagggagtagggaacctgtcctttttcatccttatattctcactgctagctcactgcctgccacattgctccgtaaaatgattgtggcatgacctagtcgggcgggagattataaaggcctgcattagacagtggtagaaactgaaagaggaagacagattccagaggagggggaacgtagacaattcttgatgactaactggatggaggggggtggggtgtggggtgaagcattgtggaaggaaggaagccgggctgaatgctgggaaacctttcagtacagtggaaagagtagggactgtagagttagtagctatgggctttgggaagaatagccttgggatatttctggggatattgcacaatcagtgaacagtgttttactgataaaatatagttatctgtaggtgaaaacttgagagatatcccacttcagggttcctgcaagaaaagtccccagggcaagggttcttctctgggaaagcccagaattaagaactggaagggtgagttgtcatcaaagaaaatgggggtaggggaagtgttaagagggctgggagggtgattgaagagtttatgggtgttgagtgactggatacttcataactcagctttattttgcttccgggagaattgagttctttatttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtcgaggctgcagtgagctacgttcacaccactgcactccaacctgggccacagagcaagacccttctcaaaaaaagaaaaaaaaaaagcattctgagttttgacagagaagaaaacatttgatggttacttatctgtctctaccaagagcctagggaacaatgccccagagcatgagctggtatatagtctagtctcctggctcccactgagaaaaagggattttgagttgaggctggctatgactagacagccattgcagggactctccagttcagcctcttagccctccactgcctccacctcatctgggcccattctgggctgtggtctcctgctctcttcccagtcccatccttcttcccccaacagcacaagtgagggtgaggcctaaagtgtagccactgccctgctgcagaacaatcagtgacttttcttagcattagaataaaactccagatgtcccaccctcccagcccctcaccctgacctggtatagtcatctcttctcctacccccaccgtgttctgacctctctggtctttcagcttcttgaacattctaagctttttttttttttttttggagacaagatcttgctctgtggcccaggttagagtgcagtggtacgatgatagctcactgcagccttgacctcccagggtcaaacgatcctcccactgtagccttctgagtagctgggactacaggcacacaccaccacgcctgactgatttttatattttttgtagagatgaggtttcaccatgttgcccagactggtcttgaactcctgggttcagatgatcctccctactagccttccaaagcactgggattacagatgtgagctactatgcctggcccctgagctctttctttttaaccaatttattatcaagtgtttaaggtattgaaaaatgagtagactcctccccaccactgtattcatgactagctccttcttttaggtgtctgctcagtatcagatactcagaggatccttccctgcttgatctaaagttggtcaccgcctctgatatgttttatctcagccctttttagtttcccataggacctcatacctatgaagcttggtacctggtatacaaaacacttgttgaggagtggaatagtattttcttgggggctgtgtgagtcacctcttttttttttttttttttttttgaggtggagtctcgctctgttgcccaggctggagtgcagtgtcacaatctcagctcactgcaagctccgcctcccaggttcacgccattctcctgcctcagcctcctgagtagctgggactacaggcgcccgccaccacgcccagctaattttttttttttttgagacagagtctcactctggagtgcaatggtgtgatctcggttccttcaacctctgcctcccgggttcaagcgattctcctgcctcagcctcccgaatagctggggttacaggcatgcgccaccaggcccagctaatttttgtatttttagtagagacggggtttcaccatgttggtcaggctggtctcgaactcctgacctcgtgatccacccgcctcggcctcccaaagtgctgagattacagacatgagccaccacgcccggccgggtcacctcttgtattacagtggtattctttatttttttatttttttaagagacagggtcttgctttgtcacttgggctggagtgcagttggtatgatcatagctcactgcagcctcaaactcctggactcaagtgattctccagtgcagtggtattctttacctgaaccagtgtacattgtgaagctctggagcccctgctttctccacttgttacacttgttagcctttctttttctttctttttttttttttttgagacggagtctcgccctgtggcccaggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttcttttttgaaacagaatcttgctctctcctccaggttggagtgcagtggcatgatcttggcccactgcaacctctggctcccaggcttaagcgatcctcccacctcagcattcccaagtagctggtactacagacgcatgccaccaggcccagctaatttttgtattttgtgtaagagacagggtttcaccatgtctcccaggctggtcttgatctcctgggctcaagtgatccacctgcctcagcctcccaaagggctaggattacaggtgtgagccaccgtgcttgcctttgttgactctttattgaacatctactctccctgcagaaactgcaggataagccacccttagaaccaatttaactggcctttttggggcttggaccttcctcatgggattgctgggttaatgttgagcctgtctctgggctataggctctcagagaacaagagtgcatctgcaatgactagtgctgcacctgtcatacaggtttgtagaaaatatttaagctgtgaatgaacaaaaggaccttatcagctattttctttcaattctttttggtttttctgtgatcctattcttgagacttttatccctcccacccctctgtacagcagattgcacatataaagatgaaataaatagatgtccattgggcaaaacaatacagagaggaggtgacacagctggggaaggacagtccagtatctgatgaagtgccagaaggggcttagggggagcatggaatggagctggaactgccaggtcagccacctcttctagtgaagcctccagagagacgtgagctccaagtaagacaacacaaggaacaaaacatacaactgaacagcaacttccaagggtctggagaggtcttcagaaggatagggagtgcccttaaacttgcaagcccagattctgcctgtgggtcatggtcgtgccataggcagaagccagtgagtcagccttggcggagctttttctgtggcttttcccactcacagctctgtgcccttctggtgcagctccagcccttgttttccagcttcatagcctggttgtcacataaatggctgcactggcttacaggtgtctgtgtataacctattgctagaatgtccattccttgaggctaggggccctgtctgtccctctcttcactttcatagccccagtgccccatagggctgctcctgatgggcaaataggaagtggttgttgagcctctaggccagtcgtgacagtgacctgaggggacttgagccctcagtcatctgctcaggagttcagggctttctcaacagcagctgacgtgcggcaggcatgctatgccaagccctgttgcaggagttgacagatgttgactcatcccctcttcatgctttctttgtcagtagatgtacatgttactcacatttataagatgaggaaaatgagacctagaggagaggccactgctgcttagagttactctacatgttgtaaatcaggggtgtccagtcttttggcttccctgggccatgtaggaagaagaattgttttgggccacacataagatacactaacactaatgatagctgacgagctaaaaaaaaaaaattgccaaaaaatctcataataaagtttacgaaggctgggcgtagtggctcacgcctataatcctagcactttgggaggctaaggtgggtggattgcttgaggtcaggagtttgagaccagtctgggcaacatggtgaaaccccatttctactaaaaatacaaaaattagctgggcatggtggcgggcacctgtagtcccggtggggaggctgaggcaggagaatcgcttaaacccgggaggcagaggttgcaatgagccaaggtcgcgccactgcactccagcctggcgacagagtgagactcagtctcaaaaaaaaaaaatatatagaccaacctggccaagataataaaacctcgtctctactaaaaatacaaaaattagccaggcatagtggtgcacacctgtagtcccagctacttgggaggctgaggtaggagaatcgcttgaacctgagaggcggaggttgcagtgagtcaagatcacgccacttcactctagccggtgacagagcaagactctgtctcaaaacaaacaaaaaaaattaaaaataaataagtaggttgggcgcggtggctcacacctgtaatcccagcactttgggaggctgaggcgggcggatcacctgaggtcaggagttctagaccagcctcaacatggagaaaccctgtctctactaaaaatacaaaattagctgggcatggtggtacatgcctgtaatcccagctactcaggaggctgaggcaggagaattgcttgaacctgggaggcggaggttgcagtgagccgagatcacgccattgcactccagcctgggcaacaagagcgaaactccgtctcaataaataataataataataataataataaataagtaaataaatgaatggttgctgaaccacagcaggacaagacagacaaaccccttttatttgtttttgttttttggaccctaacagcagaggaagagccagccagcaagccccttttgatctttggcctctgccaaccagtaccccccagaccttaacccccagccctaccaggtcccttttgtaagtgaccccacatgcctaccacagttgcaggccctgacatccaccctgaccagaggtcttccagctattactggtgtttgtgatgctgtggctgtggccagtcaaggacccatgctgggcatcccgaggtaggaaggaccatgaccacgtgattatctccctgccactatcatggcagggctgtggggtactagcctcctttaaagcattccttaggacagtaatttctgttaaatatctggagggcaaacattttaaggaattttaatgaatttttaaaaattcaaaatgaaaaatttaaatcataaaaccaaatagaagaaagacccctatgtccatatacgcaccactctgcttcagtgattatcaactcttgtctcatgtacttgacctccacacaattattattactattttttgagaaagggtcttgttatgttgcccaggctggagtgcagcagtacaatcatagctcactgcagccaactcctgggcttaagtgatcttcctgccttagcttcccaagtagctgggactaagggtaggcgccaccatgctggctaattttcttattttttttttttttggtagagaccaggtcttggtttgttgcccaggctggtcttgaactcttggcctcaagtgagcctcctgcctttgcctcccaaagtgttggattacaggcatgagccactacgcctggccatccccagttattttgatgcccagactgttttagtggctgcccactgtctgtggattctgttcttagtcttgatccttcgtgcagtgtctgcacctgcctgccagttccttgacctgtgctccatcataccaagctggcagtggatcctcagacaatctcagttcttactccctgctctgtgtccagtttgtttgcctacctaaaagatccttccttttcgtggctgagcagtgcagccgttctccaaggagactgggccttctgctgcccccaccaccctgctcttttcactgcccccaccccgctgctcttttcacaggcttggtgaggagtttccaggttgcacttggtttgtttgaaggcttatctcctcctagtctgaactcgtcagggcaggagcttgaatcaatcatttcctgcctctcaggactgctgtagcagggggattcctagatctgtccagtgccagtttcctgagtactgctgcaggcccatttcagctgctatggtgatgggggctgtcctgaggggacattcacctcaggtagagatggcagaaacaccacaggaagatgcaaccagtcagctcagctgggggcacttaaattagatccattttttttctggaaggccttttggcaatactgtttatcccagtaccttaaaaatgtcgatttcctccaagggcgcaatcaggaaagtattcaaagcctgatggtgatgagggtgctcattgccgcatcattgtctcaggagtgggatttgtgaaacagaccaacagtgggagcttggttagagttgtagctgcaggtgatgggctctgtgctgctgttgacattgacgtgagggactgccataatgcgtcaacatcgacaagcgcttgttaccaagcaggatgcgtggtacaggctgagttttattaaacagatgtctttaactggtatgaatgattttaattttttctttgtttgagatggagtctcgccctgtcgcccaggcttgcgtgcctggtgacttctctcacctgggccctcaatgccagaccagccttcccaggatgattccatcctttccatccctgcaagggagcttgaggccctttccctttcagtttgatactgtccttccaagttacctttcttcatgttggcacgagagctttgtgccacaccatgccctttctggatgctgtagtgtctggctcttcctctgtctctgtgaccctcttccctggtgaagctttgaccttggcttcatcccctccagatgacccctgatggttagctcagcctgtggtggctccagagccctcattgagtgcatcctgacacgaactgaacagattaactattttttgccttgccaacagcattggaaattccttgagtgtgggacctggactcatagctctatgtctcttatagttcttagcacaatatcttggcctagatgaagtacataataattatatgtagggttgtggaaagcagtgctggctttaattaaagcctgccatggttttgtccatcagtgctgcctaaaccgttctgaacttctcattttgaacttttttccctcacagcttgtgatggttgattttctttttgagacattcatttatttgtttgtttatttggcagggtctcactctgtcactcaggctgaagtgcagtggcgtgattgtggctcactgcaacctccacctcctgggctcaagcgatcctcccacgtcagcctcccaagtagctgggaccacaggtgtgtgcctccatgcccggctaatttgtgtaattttttgtagagtaagggttttgccatgttgtccaggctggtctccaactcctgggctcaagcgatctgctgcctccgcctcccaaagtgctgggattacaggtgtgagccactgtgcctggccctgagacatttatttaaagacaaaggggagtacaggctagagaacagaggggaatagaatagcagccaaggcataattacctctaaaccatcaccccataagggagatgttcgcctcaactttagtaatgactctctttctagtctaggtgcagggctgttaatagaggccctgtgattgggttaagggcttgaggtacaataactctgttatttagggcagtgagtccttggagaagatgctttaccttctttccaagccccatgtctccttattttgagggtgtttttttttttttttcttgagacagtcttgctctgttgcccaggctggagtgcagtggcctgacctcggctcactggcctgaccttggctcactgcaacctccgccttccgagttcaagtgattcttgtgcctcagccttctgagtggctgggattacaggcctgcaccaccacacctggctaatttttgtatttttattagagatggggcttcaccatattggccaagctggtctcaaacttctgacctcaggtgatctgcctgccgcatcctcccacagtgctgggattacaggcgtgagccattgcatccggcctgaggtttttattttgagaatatttcaaatgtacagagagttgcaaggacagtaaaagcactcaggcatcctcttccctgggattcaccagctcattctcacttttaccatcttcccatactccctgggggcctcctccttctgggcttcgtttccttttatttgtttctgtctttttaattttaatttttttttaactagcccttctctttggcaggatttgttcacttttaatccttggccccagcagcttctctgagctctgcctatgaatctgggggagagataggggctcacacaagagtgaagtgtgagctggagggctgaaggggaatgagggacatctgggccaaaggcaggggaccagcaaggcccccacccctggaacttctgttcttcccagcctacgtaccccttgcttcttcttatgttggtgggctctgggggctgggtgaaagcagtgcttgtaggttaagaagtgactcatcccacgtgcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtgttttttgtagagatggggttttgccatgtttcccaggctggtctcgaactcctgggctcaagcaatccacctgcttcagcctcccagagtgctgggattacagtcctctgtgcaattgtgtgcatcatgtgtgaaatttatcctcatttatcctcacaggcagcagttgttctattttttttttttttttttttttttttgagatggagtctcactctgttacccaggctggagtgcagtagcacaatcttggctccctgcaacctctgcctcctaggttccggcagttctcctgcctcagcctcccgattagctgggattacaggcacgtaccaccatgcctagctaatttttatatttttagtagagactgggttttgccatgttggccaggctggtctcgaactcctgacctcaggggatccacccacctcggcctcccaaagtgctgggattacaggcatgagccaccatgcccagcctgtgtttttgttttttttgagactgagtctcactctgtcgcctaggctggagtacagtggcgtgatcttggctcactgcaagctctgcctcccgggttcacaccattctcctgagtagctgggactacaggcgcccatcaccacacccggctaattttttttttttttttgtattttttttagtagagatggggtttcaccatgttagccaggatggtctccatctcctgaccccgtgatccccctacctcggcctcccaaaatgctgggattacaggcgtgagccactgcgcctggccttatttatttatttatttatttatttatttatttatttatgtatttctgagacagagtctttctctgttgcctaggctggagtgtggtggctcaatctcacctcactgcagcctctgcctccagggttcacatgattctcccacctcggcctccagagtagctgggactacaggcgtgcaccaccatgcctggctaatttttgtatttttagtagagatggggtttcgccatgttgggcaggctggtgttgaactcctgacctgacctcaggtgatccacccgccttggcctcccaaaatactgggattataggcgtgagccaccgtgaccagcctgttcttgtttatgacgtgttattccatggaggactctgttccagataactcttttattttgtgcctaatgaactttggtgttagttccagatgttggctacatgaaggcaaccccaggaatggctttggtcatgtcttctggtaaatatatgcacttaattctctgggctgtgcacctagaagttaaataaaggactgggtcagaggatgtgtctcttagcatgttctgctgaacagtgttcccaagtggtaccagtttacgttcccaccagcaaaatgtgagggagttccacttgctggacatccttgccaacacctggtattgtcaaggaacctgtctgtaacaggcactctcgttgattttgaatgcacgctgaaatttactgggtgcagtgacagtaggaagggaaaggatgattaaaaaaagaaaaaaggaatggaaaggctgatctaggagggaggaagctcataaggaaataagtggtaggatttggtgattccatgtgtgaatgctcgtattccgtgtgcatgcgtatatgagcttgcaggagaaagggaggagggaggcactggtatgcactccaccagttctcctgccacagcctctctactgatctgagggctgggtgtaaggtgatgatgtggggagtgggtgtgggtgaaatttccaacagtcagtgggagatgggggaagcaaacctgggaagagcagcctgctgcaggagcaagtgggtgggccgtcctggaggctggatgaaacctgtctgcctaggtggggatggcagaagtggcagagcagagaactccagagcagggctgtggtgggcagagcagatgtgaaggaagactgtgggatgagaggatggggcacggtggagccccatcagcctccagtcacagcagccccggtcccgtctctccctcctgttttggtcagtaccttcaggacttgtgggtgtagtacttcgttccattccggataacattgtagaagactgaaaaacaggaaggtgttttccatactctctccagagctggctgttactgacatattgatatatttccaccagtcttgtgtgtgcttatagcttgatatgtatgcattttaaatatgtaaatatatatacacatgtatttttaaagtgaaactaggctgagactgtgagttcagttttgagttataggtttcccatggcttaggttgtgttctctccctggatggagtctggctgggacctgcatgctcacagcccaggttcacatgaggtgtggatcatgcacaatcatcccacgggcttgagataagcatttgacttcctttttttttaaaaaaaaagttcattatggactttttcaagtgttcccagaagtagagataatagaaaagtggtctcccaactactttgagagttagcaacatatggccagtgttgcttcacccacccttcctcatcacctcctggactattttaaatcacatcccagacaccagatgatttcaactgtgagtacttgagtgcagatctctaaaagatcgagcttccccacccccaccaaataccacagagccatgtgagatcagcatttgggttggcagatctcctccttgccacatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcaggttagttctttcaatgatcttgtttactgggagttgagagaccttgaggatagaggcaagaaagcgtcatcaagcagcccagaggggtgtacagtgtttgaagtctcctgtattggtatgattcgagattttcattctgcaggaccaaaatacccattcctacatgtgggtggagagttaaattctgaagtatatatttttatcttgttaaaaaaacacttttatgtttctttaaaaagtaaaagaaccagaatgtagaagtttcagtaaaggaaaaagttacagtttgtttgggatacagtttgacaaatgtgctcccagctgcctgagagatagagaggccagatgtttgctttggttacattgatgactgaacaatcggtatctcatcatttcctgccttagagatgaaagcacctgggcactggggcagtaaattggttgcaggattggaagaagtccaaggacagtgtgggatgccaccctgtagctgtctagagacctagtgaaggtcagaaggctgggtgagaacaagccctgcactgatggaggacagggaaggggcttttctggctgggagtgtggtgaggcatttgagctgcagccagaaggcacctctcagattggtggggcttggggtgggggtgggaggaactgctttgcctgtgccgttggcctcactcatcctgaggtcccttcaaactccatccatactctgactgtggggccacttgcagaaggaatatgtggcaggttttttttgttttgttttgttttttgttttgagacggagtctagctctgtcacccaggctggagtgcagtggcacgatctcggctgactgcaacctccgcctcccgggttcaggcgattctcctgcctcagcttttggagtcgctgggcttacaggcgcctgccaccatgcccagctaacttttgtaattttagtagagacgggatttagtagagacgggatttcgaactcctgacctcgtgatccgcctgccttggcctcccaaagtcctgggattataagtgtgagccactgttccctggcctgtggcaattttttgagacgctcctgggggtccaaattgctaatagaggagaaacttactgtccctgtgttgactgagacaggaaggtttagataggtgaaagtggtctgggcgcagttgctcacacctataatccagcactttgggaggccaaggtgggagaatcgcttgatgccaggagttcaagactagcttgggcaacatagtgagatcctgtctctataaaaaataattttaaaaaattagctaggcctgtagtcccagctactcgggagactgaggagggaggattgcttgagcctaggagtcggaggctgcagtgagctgattgcgccaccatactccaccctgggcaacacagagagcctgtctcaaaaacaaaagaaaggtgaacatgagtttttttgttttttttttgacatagttttgccctgtcccacaggcgtgggccaccacgcccagctaatttttgtatttttagtggagatggggtttcgccatgttggccaggctggtcttgaactcctggcctctcaagtgatccacccacctcggtctcccaaagttttgggattacagacatgagccattgagcctggccaaacatgacctttctctttttttttttttttttttttttgagacggagtttcactcttgttgcccaggctggagtacagtggcacgatctcagctcactgcaaactccacctcccgggttcaagtgattctcctgcctcagcctcctgagtagcagagattacaggcatgcaccaccacgcctggctaattttgtatttttagtagagacggggtttctccatgttggtcagggtggtctcaaactccccacctcaggtgatccacctatctcagcctcccgaagtgttgggattacaggtgtgagcccctgcacccggccacgtgacccttcttaatagctattgttcgctgagtatttctctacgacactctttatgtgcattttgtcatttaattttaattttaattttctttttttttttgagacagggtcttactctttcacccaggctgtagtgtagtggcacgattttggctcgctgcagcttccgcctcctgggctcaagaaatcctcccacctcagcccccgagtttctgggactacaggcatgcaccactatgactggctaagtttttgtattttttgtagagatggggtttcactatattgcccaggccaatcttgaatcttgaattcctgggctcaagcatgagccaccacactcggcctcatttaatttttaattactttaaattttatcaacataatatatcacataaactgtaaaaagacaagaaactactgtggttcccattctgccagttctccccagaggtagcaactgcctttacatctgagctttcttccggcatatacctctgattctaggtaataggcacatgctgcttttgcaacttggcgttttacaaattatgttggcttgctctgtagctcccttccatcgccattatctctgcttctcctccctcattcttccagtattctactttctgcataaatcggtaatgaatgtttacattttctgcctacacaaatgatattcacagctgagcatagtggtgtactgcaattgcttgttatttttttcctaggaaagaattgccttttcaacactatgcccagttttctgtgtatctattcttattcttcctttattttccggttgcctctcagtacagttatcttcaggctcagtgctagtgagctgtcagtttcagttcaaacccctggcctcaagtgatccatccacctcggcctcccaaaggaggtgggcggtgaccctcttggacctcccttctggaaccctctaggcagtggccgcaggtgtggtgtgacagccctcagcgtgcttgtctgcccagactgggactgttgtcttcctttgttgggtcccttgttttctatatcctgtgtctcatcctttgtgatttattccctcattctgccagcttcctgagaagggactcctgggaattaactttctggagaccatgccagtttgagtgcatctaggccccctggtgggacatgctaactggggaatttaaaatgatgttacactgcgctgcccttgtgctggcttgtgcttctgtctcctgaggtgctagctctcagcctcatatgacttgtcttgatccctaaacccaagtcctgctctacttgggaagttcctttgagtcatttcaggggaatctcactccctacacttcctgtgctggagtgtttaatgttcactctttgggcctctagttttatcttttatctcctgttttctatctcttttacttttagctctcctctctaagtgatttcctcaattttttctttgacctttcactgctaacatgcttttatttccaagaactccttctttttccttttttgtaatctgacttttccctttttatagcacccattcctgttaaatggatacaatgtagtataatatttatatatattataataaattctaccgttttttttgataaattttcactttattgcccaggctggaatgcagtgatgtgttcatggctcactatggcctcgaactcctgggctcaagtgatcctcccacctcagcctcccaagtagctgggactgcaggcatgcaccaccactcctggcaaatatttttgtttttcgtagagatgggatcttgtgatgttgcccaggctggtctcaaactcctgacttcagctggacgcagtggctcacacctgtaatcctagcacttttgggaggccgagggcaggcggatcacaaggtcaggagttcgagactagcctggtcaatatggtgaaaccccatctctactaaaaatcaaaaattagctgggcatggtggcgcgcgcctgtagtcccagctactcgggaggctgaggcagaagaatcacttgaacgtgggaggcagaggttgcagtgagccgagatcgtgccactggactccagcctgggcgacagagctagactccgtctcaaaaaaaaaaaaaaaaaaaatcaaactcctgacctcaagtcatcctctcgcctcagcctctgaaagtactgagattacaggtgcgaaccactgcacctggcctaataaattctacatttccttcttcttgctgaatttctgttaccgctaaattactcttttcttgtggggtctttattggccatgttatggcgtctggctgcccttggctggttgctcactctgagagggaccctccaaagcctaggagtctcttccagcacgtggagcttgtcgactgggaacttcattgaaggctcatctggctgcagattctgagtccttcctccagaacaatggtccccaacctttttagcaccagggaccggtttcacagaagacaatttttctacagaccggcagatgaggatggtttcaggatgaaattgttccacctcagatcatcaggcattagattctcataaggagcatgcgacctggatccctcacatgcacagtttacagtggggttcgtgctcctatgagaatctgatgccaccacttatctgacaggaggcagagctcaggcagtaatgcttgcacaccctctgctcacctactgctgtgaggcctggttcctaacagcccacagacctgtactggtctgtggcccagggcttggggaccctgccctagagcatggtcttccagacactgggctgtgggtgaagacctggctgccagcatgctgctcactgcgatggaggaggctgatgggccagtgggtctcggcagttagcgtgcatcgatctagtcacttagaccagagcacagatgaccacacaacccacctctctcagtgtcctacctgtgccttttcaactgggtgggttggccccctagtccagtgactatccgtttcatgcttttccagagagtaaacctcctgtggtcacctggtgctggagtagctacccacagtgtaaagttggggagtgagggatgcagggatatctttcaccctctgtcccagagcacttggtgcagcctggcctcaacctggcaaagacctagggctgtcactgggtgggcgcaccccctcctcactgttacttaggactctggtttcttggtcctcttgctgtgtacgttaccactgggccatcagctttccagcttctaaaaggctgttgaggccaccatttccattcttcctggtttttttttctgtggttttagtcaggttttaagatggaagggaattaaatgtgcaggctttgttcctcatttcaacttggaggttcatatctgttatttatttatttatttagagacagagtctcactctgttacccaggctggagtgcagtggtgctaccttggctcactgcaacctccacctccctggttcaagcgattctcttgcctcagcttcccaagtagctgggattatggccgcacaccaccatgcccagctaatttttatatttacgtatatatttttttgagacagagttttactcttgtcacccaggctggagtgcaatggcttgatcttggctcactgcaaccttcacctcccaggttcaagtgattctcctgcctcggcctcccgagtaactgggattataatgcacgccaccatgcctggctaatttttgtatttttattttttatttttgagacagagtttcactcttgttgctcaggctggagtgcagtggtgggatcttggctcattgcaacctttgcctcccgggttcaagccatcctcctacctcagcctcccgagtagctgggattgcagcgcccaccaccttgcccttttgtatttttagtagggatggggtttcaccatgttggccagtctggtctcgaactccggacctcaggtgatccacctgccttggcctcccaaagtgctgggattacaggcgtgagccactgtgctcagctaatttttgtatttttagtagagacgtttcaccatgttggccaggctggtctcgaactcctgacctcaagtgatccacctacctccgcctcccagagtgctgggattacaggcgtgaaccaccacacctagtccaaatcttttttttaatatgggaaaatcttttttcctttatagtgtctgcttctggtgacatgcttaggaaaccatcatcctgatattgtataactctccttctgttgtcttgtggtcctctgtgatttaggtttttaaacacatagggtaaagggtcccacatacaagctgtgggctcctgtcccaggtgggcaagcaggctgcacacacaggcagcaatttactgggaggcttcttgggtggggtgaagtggagctgccaaaaatttattctgccctatgagagttcacttgattgatagatgttgtgtttctcaaaattagaaaattagaagaaactcacagaagtttccttcgagcagaacataaatcggctgagaggaatcatcctgcccccctgaggtcaggagggtgaatctgtgccccagggaggaacgcaccttcctgctttagacaccagcagaggacagagaagctggctgtcctgggaattcatgccctcattcagcaatgggaaagcagttggaccagggaagggggcctggcagtgtggcagggggagcagtggtaaagagggtggggtcaggggagaggcctcactgagaggggagagggtccttggtgggaaccagggcggttgtggaaggaagagtcagggcgtggagcagagcagagcgggagttggggtggggaggccagttcatgcctcatcaacatgcctgtgtgagtgtccttcttgcgggcggtggagctggcctcagggtacactgcaggtgactcagagctccaatgggagggtggctctgcctgagggagctgcacatgctcattgggccatcgtctgctgaggagggggcaacaataacctcaacacatggcggaggtgttttgggatgcatcctattgcacatttgggcaggttgttgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttgaggcctggattcccccatggctgccacgctgattctccgttctgcacgtcgtgtcccatcaaaatgcatgacagtaccactccttgtgttaaaaagagccagttattgtgcctggcagtgatgactgcccactgcacacaaaagtggacgccgttgtctctgctctcagggtgttcttagtatagtggggctggcacacagaaaccagagattcctccaggaagtgccacagacatgggtgaggtggctacagggtttctgtgcagccgacagcaggggtgcctgggtggaagcagggtgggaggccctaacaggcctgatgggatagtcaggcaatgtgccaggtagtaggtcatcatccctggggccctggggagagtgtgtggggcaggcgcaggagcaggctcctcagtgggctcctggacaggctgcctgctctgctggtgaggagcgaggctcaaagcaagcaggggcctgggttgcttcccacactcagtggcagttgctcactggcagtcatgtgacctggggagctggcgagggcgtgggggtaggaatgggaacgggagacagaggccctttgggaggaattgccacagatgcagtgggagttggggcaaagatttgaactttggagaattaaaggtggcagtcagaaagtgaagggagttcccaagtttctgggatgggcacttggtgctgggagatgaagacacgaagagcttttcttgatgtatccctgctggctgctcaggcagggtcgggcaatgccattaagacacactgtgttctgggaacagttctggacagtaaggacatcctcagaccccttagtgggggagctccaagggcctgtaatgatgaatcggtcccctgggaggcttcagtctaagctagataccagttgaaccctgactgagtacacagacatagctatggcaaccagctagaccatggccaaaggcagagcattggagcccagttcacagcaagggactgtgtgctctgagccggtaacagtccttgtgttcagaggtctggctggtcgcaaccagggagtggcccccagcccccttcctcagctagagcgagcaccacccaggcagccttgggttctttggtggccgcctcataggcctgtactgtttgtgaacctgttgcttatgttggacaggactgtggcaggacagccatcaagggtcttcccttgtgagctgacaccagtctgctctttgtcctcctctggctggacaggccctcgtcttcccggcttgcttgtgtgggggaagagctcactgtgacatgtgggttctctgttctttgtctcaggctgtgctccttactccatgttgggggctgtctccttgtgtgatagtttcctttcatttcgtgacagtggctcgaagggttttgttttcaggagacagagactgaggagtagccattcgggtctggctgctcaggaaggcatgctggggatggcagcagagcccagctcagggagatcagaagggggctttgggagcagccagtgctgttctgaaggtgggcctgggtcctgcctgcagcctcccgcagcgggtgtgttaggtctaagggaggaaggaaggggacttgacctcagcaggagtgtgaaatgggtaccctcctggagtcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgtttctggcctccagcttggtccatgctcctcaggctctgagtagctgacggtgcccacagtgtccatgtcatctgtgacattacccaggacaggacagggcccgtctgccagtacatcccctggtgtatggtgccaccttgccttcagctcaccaagcatatttcttcaacctggtcatcccaccacctcagagctattgcactaagctgtgtttctagatcttgtctctctgactgtgccaggtgtctctgctgcaccaagacagtgtctgtctggggcctgccagtctgctgacactctcaaaaacggccagtagcagctcaaaaggactgcttttgtatcaaagcctggctttgctctctgatcgctgctggtgggcacagagcccatctgtgtaactggttgtcactccccagactcttctgcacccttcttcctctctgactcctggccacatctgccacccacagcctccccactccttacacagccagcctccaggccgtcctgcttggcctgcaaatgctcccctgctgtttctactgctcttccctgagtctccctattggtcccagtgctttgggaggccaaggtggaggatcacttaaggccaggagtttgagaccagcctgggcaacaaagcaagaccctgtctctacaaaaaaagtaaaaaataaaaaaattagccaggcgtggtggcgcatgcctgtagtcccagctatttgggaggctgaggtgagaggatacttgagcccaggagtttgaagctgcagtgagctgtgtttgccccactgcgctgcacctgtgagagagtgagacattgtctcaaaaaacaaaagaagaaaaagaaaaaaggaaggtgggaagaacaagtatgcctttgaagggcatacctgccttgaggggcacagatgaggcaaccttcagaaaacaggcctgtgcagccacttctatcagaaatgctcactgacttcttggggcctagcagctatcgtctcagcctctgggtgtggagaccctgccccatgctaacctgagagcatgagtacagggtcctcccagcccacccatgcctcgcttccccaggactctgacccagtgccgcgcgtgagttggttgtcattatcctcctggattgttaactctctcatcttttgtggccctggtgacctttcttacttgtctgttccacacctggatgccttgtgagcagaaaccccttgctgcctcctcgcctcccttcaggcttcaggaagcagacagggaggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcctcagcctcctttgtagctgagattacaggcatgcgcaaccacaccctgctaattttgtatttttagtagagacagggtttcaccatgttggtcaggttggtcttgaactcctgacctcagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccaggctggagtgcagtggcgtgatctcagcctgctgcagcctcaatctcccgggcttaggcgatcctcctttctcagtcttctgagtagctgggactacaggcatgtgccaccacacccggctaagttttttattttttgtggagacgaggtcccactatgttgcccaggctagtcttgaactcctgatctcaagctatccccacgccttgccctccctaaatgctgggattacaagtgtgagccaccatgcccagccttcaacattttttaaagaaactttatacctgttagcagtcacactcccttttccttcaaccctcagctaccacttatactttctactgctgtagatttgcctattcggaattttccatataaatataattgtacaacatatgggttttttttgtttgtgcgtgtgtgtgtgtgacagttttcctcttgtgcccaggttggagtgcagtggcacaatctcagctcactgcaacctccgcctaccaggttcaagcgattcttccgcctcagcctcccaagtagccaggattacaggtgcgcaccaccacacccgactaattttttgtatttttagtagagactgggtttcatcatgttggccaggctggtctcaaactcctgagctcaggtgatccgcccgcctcagcctcccaaagtgcagggattacaggcatgagccaccgcacccagccacgtacaatatatgtttttattttgcagctggcttatttcacttagcataatattttcaaggttcaaggtccatgaaccatgtttggtatatactttattcctcttttgttttttttagatggagtctcgctctgtcacccaggctggagtgcaatggcacgatctcggctcactgcaacctccacccactgggttcaagcaagtctcctgtctcagcctccttagtagctgggattacaggtgtgtgccaccatgcctggctaattttcgtatttttagtagagatgggttttgcattggtctggggctatgttggccaggctggtctcaaactcctgacctcaggtgatccacctgccttggcctcccaaagtactgggattacagacgtgagccaccgtgcctggccaactttattcctttttattgtcaaatattccatttctggatggccatatcacatattttatagccattcgttagttggtggacatttacatagtttctactttttggttattatgagtaagcagaacaatagttaatgtataaatttttgtgtgggctgtgttttcatttctcttgggtatatacctaggggtagagttgctgggtcataccctacctctgtatttgaccttttgaggaattgccagatgtttcccaaagcaactgtactattttaaattctcaccagcagcttaaatgaggtttcaatttctcctcatcctctccaatacttgttattgtctattttaattgtagccattataatgggtgtgatttgcattgttttgatctgcatttgcctagtgactaatgatgttgagcatctttttcatgtgctttttggccatttgtatattttctttggagtaatgtctattcagatcctctgtccatttttaaattgggttgttagtctttttattgttgggttgtaatagttctttatgcatttggatataagtctgttattaaatatataatttgcaaatatataggggggattttatttatttatttttatttttgtttttttgagacagtctcgctctgtcggccaggctggagtgcagtggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagggaaaaggctgtgccactctttctgaagatgacagtgtaggcagcctttccattttgtgccaaaaataaaattttaaatacataaatcacagtagtttctaggacaactgggtaactacatacaaaatattgaggttgagccccaacttcataccctatacaaaacttaactcaaaataaaaaacaccagccaggcatggtggcgcgtgcctgtagtcctgcctaatcgacaggctgaggctggagggtcacttgatcccaggagtttgagattacagtaagctatgattgtaccaacatgttccagcctgggtgacagagtgagactctgtctctaaaaaactttttaaaaaattaactcaaaatgggtcaaaaacctaaatttacaagctaaaactataaatatcttagaagaaagcagaggcgtacatcttcatgaccttggattaggcagtagtttcttagatatgatgccaaaaaagcacaagctacaaaaaacgtagataaatttgacttcatcaaaattaaaaacttgtacatcataggacactgtcataagagggaaaaacaacccatgggatgggagaaaatatttgcaaatcacatatcaggtaagggtttaatatccagaatacataaagaactcctacaactcaacaacaacaacaacaacaacaacaaaaagcaactaaaaaataggcaaaatacagccaggcgcggtggctcacacctgtaatcccagcactttgggaggccgaggtgggcagatcacgaggtcaggagattgagaccatcctggctaacatggtgaaaccctgtctctacttaaaatacaaaaaaaggaaaaaaaattagccaggcgtggtggtgggcgcctgtagtcccagctactcaggaggctgaggcaggagaatggcgtgaacccgggaggtggagcttgcagtgagccaagatcatgccactgcactccagactgggtgacagagtgagactccgtctcaaaaaataaatacataaataaaataaataaaaataaatgaaataaaaaataggcaaaatacttgaataaacctatctccaaagaagagatacaaatggccaacaaccatgtgaaaagatgctcaacatcactagtcattaggggattgcaaataaaaaccacaatgagatgccacttcatttccattataatggctatgatttttaaaaaagacaataataagcgttggcaaagatgtagagaaattggaattctctttctttttgagacagtctcgctctgtcgcccaggctagagtgcagtggcacaatctcgtctcactacagccttcgcctcccaaattccggtgattttcctgcctcagcctcctgggtagctgggactataggcacacaccatcacacccagctaattttttttttttttttttgagatggagtctcgctctgtcgccaggctagagtgcagtggcgggatctcggctcaacgcaacctccgcctcccaggttcaaacaattaccctgcctcagcctcccaagtagctgggactacaggcatgtgccaccatgcccagctaatttttgtatttttagtagagacagggtttcaccatgttggccaggatggtctcgatctcttgactttgtgatccacccacctaggcctcccaaagtgctgggattacaggtgtgagccgctgcacccagccaatgcccggctaacttttgtatttttagtagagacagggtctcatcatgttggccatgctggtcttgaactcctgacctcaggtggtctacccatcttggcctccccaaagtgctgggattacaggggtgagccaccgtgcctggcagagaaattagaattctcatacattgctggagagaatgtgaaatggtgctgtggaaaacagtatgacagttcatcaaaaaattgaatgtagagttaccatacgacccagaagtttcactcccaggtatatatccaagagaaaagaaaacatgtccacacaaaaatatatacacaaatgtttatagcatcattataacatcataaatagccaaaaatggaaacaacccaaatgtctaccagctgatgaatggataaacagaatgtagaatatccatacaatgaatatcatgtggccacacgaagcaatgaagggctgatacatgctacaacatggatgaagctaaaaacattacataaatgaagcagtcacaaaggatgacatgttgcatttttataaaatgtccagagaatacgaagatctatagagatagtgtattagtttcccatggctgccataacaagttaccataaagttggaggctcctatctctgggtccatggctctgacttctgagcccatgtctctgccctcactttcttaaagggtagcacatgtttgaggctgcgtagttttatcagcctattcctgcttctaaaattttgggagttcttctttgattttgcctagtctataaactttctactccaagctggcagtgtttctgctggtagaacattctcaaaatccttgtggaacttctacatatatgatggaattcatagtattagatgaggtttctccacagatctttcctagataatttcatctctcttcctcacttctgtgagatgattgaggggattcatgagtcccatgtttaatctctttggcactagaaaaatttggaagatatgccacacccttggcattctctacagaacacactttcctaacagtaaatctcctagttttagcattttggttttttccaatctaaatagcctgagaatttcccaaatcattaagtctagattcctttctgcttaacagttcttccctcaatttctctctcttctttgtgtgtgtgtgtgtgtgtgtgtgtgtgtgtgtgtgtgtgtatttttaaaattctttttattgtacccttaatttatctctttcatgttgcttttttttttttttttttttttttttggagacggagtctcactctctcgcccaggctggagtgcagtggcgtgatctcaggtcattgcaacctccgcctcctgggttcaggtgattatcctgcctcagcctcccaagtggctgggattataggtgcccaccaccacacccagctaatttttgtatttttagtagagacagggtttcaccatgttggccaggctggtcttgagctcctgacctcaagtgatctgcctgccttggcctcccaaagtgctgggattatagacgtgagccaccatgcccggcctcctcttgcattttactacaagcagaaagaagaaaccaagctgagtccttttttttatttttttgagactgagtctcactctgtcgcccaggctggagtgcagtagcgcgatctcggctcattgcaacccccacctcccaggttcaagtgattctcctgcctcagcctcccaagtagctgggattacaggtgcccaccaccacgcccggctaatttttgtatttttagtaaagatgggatttcaccatgttggccaggctggtcttgaactcctgacctcaggtgatctgcctgcctcagcctcccaaagtgctgggattataggcatgagtcactgtgcccggcccaagctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgtttctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggccgggtgcggtggctcacgcctgtaatcccagcactttgggaggctgaggcgggcagatcacaagatcaggagatcgcaaccatcctggctaacatggtgaaacccccgtctctactaaaaatacaaaacaactagccaggcgtggtggcgggcgcctggagtcccagctactcgggaggctgaggcaggagaatggctgaacccgggaggtggagcttgcagtgagccgagatcgcggcactgcacaccagcctgggtgacagagtgagactctgtctcaaaaaaacaaacaaacaaacaaatttaatctcacagttttcaaggccagatgttcaaagtcagtaccatgggtaaaaatcgcagtggcagcagggaggctataggagaggaacctgtttcttgcatcttttagcttttggtcactgctggtactccttggcttgtggctgtatcactccagtcttcaagtccagcatcacgaggtaaatacattctctgtattccatcttcacgtcgccttctctgtgtgtgtgaactttccttctgcctccctcttaggaggatacatgcaattgcacttggggtccacccgcataacccaggatagccctccatctcaagatgtttaacttcatcatatctgcaaagacctttttctcaaataaggtaacatttacaggttccagggaataggacctgatttaaggactgttatttagcctgccacagacagaaagttgattattgattgccaagggtgctgtagggaaatggagttttcatttggagtgaagatgatgttctaaaattaggccaggcacggtggcccatgcctgtaatcccaacactttggaggccaaggccagtggatcacttgaggccaagagtttgagaccagcctggccaacatggtgaaatcctgcctctactaaaaatacaaaaatcagtagggggtgacagcgcatacctgtagtcccagctacttgggagggtgaggcaggagaatcacttgaacccaggaagtggaggttgcagtgagctgagatggtgccacttcagcctgtgtgacagagcgagactccacctcaaaaaaaaaaaaaaaaaaaagaaacaaaatgctttaaaattgattttggtaatgctgcagaactctgaatgtagtaccaaaaaccattgaatggcatgttttaaatgggtgaattgtatctcagccagcctattacatatatttttaatggaacgagtgaaaatgatgaataacaggtctgttttcccttggtggccaggtcagggccgtgtggtttccttgggtggggggcactgctggggctgccttgtccctacttggtttctgatggtgtgtcctgtgggctggggccaaggtcccatggggctatggatactatcatggaaccactctttctggaatttgatggtatttcaaaatctattaggaaaactctgagacatgaaagcacagaggcgtcatattcctctaatctggagtcagcagttgctgtggtttggtgacttttcccttggctgtctctgtgtccctcctgaagtgtcgagggcacatccccaccctcagggttgtatctctgctgagcatctccacactggcctgtgctagggccccacctgacaatcacatggagtcactattgtcatcaatgggaaggcctctttcaagtttcaacgcttttttcctaatagttggcttctttgaatcaggatccaaacgagggtcttttctcccctctggcccctcccagcctggtgaaggagcagcccagctgtcctgcagccctccccatgggctctgatgtctcccaagctgctgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaatttggaggtttggagagcaacaacagcctgacccttgtaaagctcctattatctttccgatggtttcatcatttaattagggcttgtagactaattctggcttttctcccacattcgttacatggagttttttttgtttttttttttttgtcaagaaaggttttctttcgtcagccagggctagatgattgtttgaaaccctgtgtgttcaggacctccaggaatgctgtttttctgatctttccagtctaaggagtccccccaagggccacagatgggttctctttgagtgacattttgagctcagggctgtgtatctggggtgttctggtccattgctgtcattcattttgatgcttagatggtcccatcctcatctagcaggagctcctgtgtctcttggggccctcacacaacctctttagtttttcttagtctgctggcatttagacccagattggctgctcctctagggagtgaaccctggggacttctgccggtaaagtggcatttggagcatgctacgtgggcgctggtctgttcattgctttgggcctttcagtgaacagaactaagaaaaaacatgtttttgaaataacagcaacaacaaaaacccataattttacactaatatttctaattcaaatttaaacttatatatagggtttttacttctttcattttaaacatgtgtcttttctgttactatgaatatcttggtttctaatattattagcatacttggttgctttactttaaaatcatttcagaataaacagtttatattaccactgataacaaaaggtagactaaacatttaagattaccttgaagttctaattgtccttaaaatgtatcccttttattgagaacattttgctttttgtttcatttttttaaaaagcctctcaaaagatttcttttctctatatgattctgccaccaacttaatattcagctcatttgttttagtttatttggaatgtttaggaattggacctttttctttagatttgctatacttttcattttagaaaaatattttaggctggctacagtgactcacacctgtaatcccaacacttttggaggttggggactgagcaaaagacaagccggccaacatggcaaaaccgtgtctctccaaaaaatacaaaaaattggccaggcgtggtggctcacgcttgtaatgtcagcactttgggaggctgaggtgggcggatcagaaggtcaggagatcgagaccatcctggctaacacagtgaaaccccgtctccactaaaaaatacaaaaaattagccagacgtggtggcaggcgcctgtagtgccagctacttgggaggctgaggcaggagaatagcttgcaccacccgggaggcggagcttgcagtgaactgagattgcaccactgcactccagcttgggccacagagtgagactccatctaaaaaataaaaataaataaataaataaattagctggacatggtactgcatgcatgtagtcccagctgctcaggaggctgaggtggggaggctcacttgagcccaggaagttgaaactgcagtgagcgatgatcgcgtcactgcactccagccagggcgacagagtgagaccccatctcaaaaaatatatatattttttagagaaataaaattcactgagttgcccctgagttgcccaggctgaactcctgggtgtaagcaatactcctactttatccttccaagtagctgggattacaagactgtgccactgtgcctagctttgatttgttttttttgttttttgttttttgttttgagacagagttttcactcttgttgcccaggctggagtgcagtggcgtgatcgcggctcactgcaacctctgcctcctgggttcaagcaattctcctgcctcagcctcccaagtagctgggattaccggcatgcgccaccaggcctggctaattttttttgtatttttagtagagatggagtttcaccatgttggccaggctggtcttgaattcctgtcctcaggtgatcctcctgtcttggcctcccaaagtgctgggattacaggtgtgagccaaggtgcccgacttgatttggctttatcttctcaatagtaaaagatttatgtgcttctgaagtgaaaacccataacactgtggatttagagagggcacatttccagcccagttcctgatacttgctgggttgtcgattttcaattttggtgtatctttccagtgtttctcatggcagatttaagcaaatatgtgtgtttacgttccacaggtcttatataaaaggtgtatgtcatgcagtgtatgtggcacggagcacgtgtttctatcctttctccttccttgtgttcactccacaatatgttgtgaggcacttgtgcaagatttccacatgtcaagcaagtgtggaaattctatgaagcttttaactttttgaggtggggtctcactctgtcgcccaagctggagtgcagtggagtggtcacagctcattgcagcattgatctcccaggctcaagcctcagcctcccactttgaggccactggcgtgtgctaccacaccagggtaatgtttgtttgtttgtttgttttgtagagatggtgtcttactatgttgcccaggctggtcttaaactcctggcctcaagggaccctcctgccttggcttcccaaaatgttggaataatagatgtgagcctccacgattggcctctatggagttttttaaggtttctgttttcttatctgtaaactggatgtgttagtagtacctgcctctgggtggttgggagaaatcaaggcgataatgcatgtgaattgatgactcctgtgtctggcactgtaaagtgccaagtgctagctgttactgtcatgatgttcattgtttatggtttgtaatactcagcctcaggtacagctggacacttatattttgatagccagcaggggagctggagcagaccaagtgaagatagggagtttcctgactctttagcccttttttctgcagcagttctaggggagttggtgtgctttggagcagaaaggggcataataatctgtccatctggatgggggtgggggtggatggtgaggagtcaggagtgaaagagcccagccagggggatcagaggcgcagtttcagatccagggctttctcccctggaaaggagttgttgtggttgacccattgcgttcagcccctagatgttcctagataaacctgcctttgggggaatgtaggaagtatcatcgcccacaagaaagctccttggctggcagcatgacagcttcctgtgcttgtttctcacatcaggcgtcccctccctccccgctccccactaagcctcctcacgctggtctggtagcagagctggagcagatggcagtggctgcgcctactgtgggtcaggagtggtgctgggcactgcaggatgatgatgcctgcccactgcattccaggtgctgggctggcagtgggtcttgctcagccctggtgttatgcagaagggctttggtgacatggtcctgagccttgtttgagtgtcttatgtctaagtaaaagtatcttgttgcttttgaaacctacttccccttgttttaccttttatggatgtggagaaaacaaattcatttaaagtatcgcagacctaaaaaatggtccagggccttaggagctgtgaggtgttgacctggctggcccccaggcccttctcccctcatacatggccaccttgcttctgttcctgagtgtcctcaggttcccacacctccattgcccccattctcataccactgtccttcagggacaggctgcctgtgggcccccttcacacgcacatcagctttcctatcagtaattgatggggatagccggaagctgggcgtgttgacagaactgccttggtgtccccttgttctggccaggcctcgctgcttatcccagcttttcctctcccctgggcctttcttcttcatgttgtcctgtgctaattccccgagctgaaaaaaagaagtggggtagagtttggagatagatgtgggatgataaagatttcaaaagtgtctttgtatttttacactcatctgagaccacttttcatcatccttccctctgccctgccatcttatgagtgtagtggatggactctgagtgtcacagtgactcaggaggaaggttgggtgagcagggcacggagccggggctttgccccttccaggctgccctgccagaaggatgggcacttcagcagaagacaaggatgcttctctgaaataagactttacctcagacatccgtgtattgaccacaagaccaactcacagtagtgatttccctgaaacacttgggagtgagtgtccttggggccaaagaggacaatgggtgggaggcagcccctgccagacaatctcagaaacacagcagcttgcatatagcgggccttggcagccagtggccttcacctcacctgagagtgggcttcaccctctgccttgcctgtgcgtaaatggagatgaacacagattctcccggaaagcgcagccaggggagggccgcccagattttcagcagatactgcgtcatcagtgaaaaggcagcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggtgccagcaggcgagggggcgggaagggggagtccgatgactgcgcttcttcatctggtattaaactgcttcctgtttttacttttaggacgaatacctttctctcgtggccaggctcattatccattttcgagacattcgtaagtaagattttgcatttctgggttgttgagatctctgtgagaggccagccctgacgctgcctcggcagagctttctgggcaggccgtggtgcctgagtcagaaggtctgtgtcacctcacttgcttctgggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctgggtcaaagggagacattgagcactccagagcctggtaggttttgcttctttccacactaacttttcaccagaatggccagcaaagtgaacttcactgatctcactctctgtggtgttggaaagtcactgggatgtgtaagaggagaaggagcagcccagatgatctggcccagatgcgctggcagactccgcatgttctgctttcagggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctaggtaacagagacactgcctcaccagagtgggctgcaaagggaggcagtgtcaagtcttggcaccactccagccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagtggggagtactaggagctccgtggggattaaggcttgggcaaatgcctacagaactgacctacccatggaaatatgtggttatataaaactatgtttactttcgtttttttgtttgtgttttcatatagataacaagaaatctcaagcttccgtcagtggtaagagttttcccttttgagttaaagtttctcccaactttggatttgaggtggcaagaatgacatagtgcatgcctcatgtgcctgggttaacctgtcactagaggagaatgcttgcggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttgggacatttctcctcagtgctctgtggagccctcctctgcacccctaagctgttctggcatggtggccctgcacacaggggcccaggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaaactgggctgtgatcaggtgttataggtgaaccaaagctgctctaaaggggaggcaaagaacctccctcttctttccaggacctgtcttttgagacggggtctcgctctgtgggccacattggagtgcagtggcacaatcacggctcactgcagcctggacatcctgggctcaggtgatcctcacaccacagcctccaaagtagctgggactataggctcacagcaccgcgcccggctaatattttgtattttttgtagagatgggacttcaccatgttgcccaggcttatcttgaactcctgggctcaagcgatctgctcacctcggcctcccaaagtgttgggattacaggcgtgagccaacgcgcctgcccttaggacctatcttgatgtatccttgagtcccatcaacatttcttagagtgtgctgtgcccactgcaaagtgctttagtgtttttttcccctttcatgtaactttttatttttaaaataggagtcacaggaagttgtggaatagcatagagagttcccacatgccctttacccagctctccccaataatagtatcttacatagaacattgtcaaaaccaagaaattaatgttgaggcagtgtaatcacctcagttagagacttagcttggacttcatcagttttttttttttttttgagacagagtttcactcttgttgcccaggctggagtgcagtggtgtgatctcagctcactgcaacttctgccttccgagttcaagcagttctcttgcctcagcctccgactacctgggactacaggcgcctgccaccatgcccagctaattttatatttttagtggagatggggtttcaccatgttggccaggctggtctcaaactcctgacctcaagtgatcttctctcctgagcctcccaaagtgctgggattacagacgtgagccatcacgcccagccgacttcatcagtttttttacactcattcttgggctacatatatgggtatgtgtaggtctgtgagattttaccacgtgtcaaatcaagtagccatcaccacaattggcatgcggagccgttccattaccaccaaccaactctcttgtgttacctctcagagatcgcgccctccctccagccttaagcagtgacaattgctgatctgttgtgtgtctctgtagttctgtccctttgtgaatgttgtataaatggaatcataccatatgtgactttttgagattggctttttaaattcaatctgatacccttgagacccagccaggttttatcagtaattcattccttttcatcactaagtagtgttccatggaacggattttccacagtttgcttattcattcacccatgaaggacatttgggttgtttcctgcttttgcttactattatgcaaacaaagctgctgtggatatctgtgtacaggcttcagtgcttcaatatatttttgtcacacatccctcatgataaccctatgaagagggcagcatcgccccctctgctttgtcagtgtagcagctgctaaggagaactggagtcacaccccaggccaagagctgggatcgaagctgctgcctgaccccatcctcacactcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttcatctagtgccaccaagaggacagagcctgggtcagaggttttgccagggactctcaaagggtaggccaggggacattgtgatagttttcaggtgacccaggttagtcggaaaaggctgaaactgctggttgttcctatggctggggctgcagtacagagttggaagcaaagcttttcactctgcgcatttttgtttctcatgagttttatatgacgtgcatgtaaagccgactttaaaaataatttctactgccagttgtgtgatggactggggtgctgaggacatgttctcctcctggataactaggttctggttaggatgcactttggaatgctggcctgcagcagttggggaggctttgtcctcctgagcctcagctgctgcaaggtgggggaagaaagcttgggattcctgtagtcagccaggatttgtgctgggtcctgtgtcaccccccataccccccagaagcaggtgcagattggagcaggtgcggattggaggaacatgtccccagtgtaagacctgtgacagttgcacattaaggtcaagcaatcagcatacaaagatcaccagccttgaagggaaggagagacaccatgaaggtgaacagaaaaaatagacacatgtaggcatgcccagtgaccacacacacaggaactgttagttatgggccatggggtatataaagaaataaagtggagagccgggcacagtggctcacgactacactcctggctactcgggaggctaaggcagggggattgcttgaggccaggagtttgaggctatggtgaactatcattgcaccactgcactccagcctgggggatagaacgagacaccatctctgaaaaaatagaaaacaaaaaggaaaagaaagagcagaaattcaaatgaaaaagcatcatcaggagcaatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaagaaatgaggataagatcagaaattctaattggcatccaagcaaagccccggaaggatcaaatggagagaatggaagaaaacaatatgtgaggggataactactgagaaaagcccatctggccccaaccaagttagccatctcatctgctgtgagactgcagagcaccaaaggccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatgggaaaagaaacgttgagcataggtgatagtaaatgtgtataaatctaaagcagtgattctcacccagggtgacattccaccacaggggatatttgacaatgtctggagacattttgggatgtcactactgtgggggtgctgctggtgcgtaatgggtggagaccagaggtgctgctaaccatcttacaaatacaggtcagtccccccaacaacatagaatcatctgggtcaagtgtcagtagtgaaaaggttgaaaatcgctggtgtaaataaaaatttacctctgtaaaataaaacagtcaggctaacctccatacagacttgccacattccaagcactatttcatttcttttctattattattattattattattaagatggaatctcgctctgtcaacaggctggagtgcagtggtgcaatgtcggcccactgcaacctcgacctcccaggttcaagcgattctcctgcctcagcctcccaagtagctgggactacaggcgcgcgccactacgcccagctaatttttgtatctttagtagagacggggtttcaccatgttggccaggatgttctcgatctccagaccttgtgatctgccctccttggcctcccaaagtgctgggattacaggcatgagcctccgcgcctggcctattattattatttatagagctagggtctccttatgttgcccaggctggtcttgaattgctgggctcaggcgatctgctctgccttggctatccaaagtgtgagattacgggcatgagccacagcacccaaccccagggactattttgagtgttttacttacataatagattatttaattcttagtccagtgtgtggagtaggtactattattgcattttctaacagggaaaactaaggcaatgagcagtgacagagttgaggttttgagtccaggcagcctagcttggaggctgtatccctagcctcaaatccatccagcctcttaatagaatgtctgctgtgaagagttaaaatagatcaacaaaatatgaaataaatgcaagtcagcagggagatagagcgtgaatatcggttctgtcgggtacatataaaacctactttaaaaagtagtaaatttgggaaatgctaaaatattgatgaggtttatactttaagttaaatatgcatgataaaattgaaaaattattgctaaaacaatggaaataattcataaaatttaagatcaatagaaaaaataggataaggcagaaatccagataatacaaagttcaatccaatcatccaacaaaaatgcaatcaaaaaagacaaagaagcttagaaaaggaaagacaaaggccgggcgcggtggctcaggcctgtaatcgcagcactttgggaggctcagtcaggcagatcacgaggtcaggagattgaggcgatcctggccaacatggtgaaacgccgtctctcctaaaaatacaaaaagttagctgggcatggtggcgcatgcctgtaatcccagctacttgggaggctgaggcaggagaatcgctagaacccgggaggcggaggttgcagtgaaccgagatcacgccactgcactccagtctggcgacagagtgagattccatctcaaaaaaaaaaaggaaaggaaagacaaatattaatagaaaataagtttaaaaatataagtaatcataataaatgtgagtggactaaacttttctgctgaaagataggaaatgtgagaacaaatggaaatgaaacagcacagttgttttattgttagaagaaacacacacctacaataaaacatgcggaaggatttaaaaataaaagatgaagaaaggccaagtgcagtggctcacgtctgtaatcccagcacttggagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccacagagttgtgcagccatcagcacaattttagaacatttttatgttcaccccaaaagaaacctcacctcagaaaatcttgtaattgactgttcatataagcagttttcataatagccacaaagtagaagcagcgcaaatgttcatcacaggaaatcggtgtagtagaatattatttggcgataaaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacaggtaccaggtcccctgttcctgctcttggcctccctcctgcagcgtgagccctgggctggcatcagccacaatgctgggtgcagtgcccggagccagccgagggttctcttgacacgtgtgcctgcccttttccatgggcttctcaaaaagtctgggacaaggccgggcccagtggctcatgcctgtaatcccagcactttgggaggccaaggcaggcggatcatcaggagttcaagaccagcctggccagcatggtgaaaccccatctctactaaaaatacaaaaaattagctggacatggtggcgtacacctataatcccagctatttgagaggctgaggcaggagaatcgctagaacctgggaggcggaggttgcagtgagccgagatcgcgccgctgcgctccagcctgggcagcagtgagactccgtctcaaaaaaaataaaaataaaaaaggaaaacaaaagtctgggacaggcaggagaaacaggccctgactcactaggaaggttctgtgatcgagcccttccatttgggcttgggcatctggcggtgggcctcctgtgtagttcaggggctgcgagggattcaaacaagagtgagctgaagcaagaagtgagacgaacactctgaggcttgggactacttgagccattgtgggccattttggctgaggacacatgtgcctcctgtttacctctgtgtcttgggttctgggctcagtgttagtcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgttctgtctctagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtggcccacagtggagcacatgcagcccgtggctctgtcagcagtagtttctaggctctttggctagagatagcatatcctattcttcaagtgctgagacttcaggcagcccccaccccttgccagccctgccgactctagcatggctcagcagggaagcatgtgttttgcattttgtgttctgagagctgcttctgcaccccgcacagggtactgctgctgctactggggcaccaagtcgcattccaagcagtgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacaggagctactacgccctgccctctgctggccggctaacccagctttccttcaaggaatcaggctgagtgaagctcttgtggaccatcagcatgcttggcccagaggatgagcaggctaggctgtaagctctgcattggaagtcgtcagtgcttgtgatagctggtgctgagggatgtgtggagacatcccagtgggagggccacattgccacttgccagaattggatttgagctaatgggatcctagatggccagtaaggtgacatcacagcacatgaggtcatgaaagtcccattcctcacctcaagaaaggctccatttcctaagcttccacaggaagactaggctctgctctctgacccaggtggttccaaatcacattctctctttctccctcaaggtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaacatgtatcagagagtagaaggctgcagttttctcctcacctctcatcttccatttgagagtctgagtacagagctgaccagggtggagggcagctttctagacactcggaagcagatgggagccacatgcagcaggagcgtgggagaaggcatcctggtgctcgcctgcactcagggactccggcgctgtgtggtgagaagcgtgccactcccacattgctgagcttgctggtgtgtcacatgtgtggaatgtgtgtgtgtctctgtgtgtcacgtgttagtggaatgcagatggccttgtctggcctcctagtgtcctgggattggaggcccagggtttctgtaccttttcctataacccctcctctccttcttgtggggagacgtacagtctggggcttcagtttttcctcttttcacatgatggtggaaacactgttggtcctgactcggaaggggcgttggctttagaaagagtcagaatgtgctagttgatgtggtaagactgtggctgggtcccagcccacagctggcagtgcgcctgcactttgctgtcgtcttaagggtacctggccttgtggttttctgcaggcctgctgggcgcagcgcctgggtgcacagtgcctcgtggcaggcttcatctcacgcttggggggtgctcagtaatgtccttcatggtgcctgctacctcttttaagtccctgggaagctgcctgaggagggaatctgaggtatttggctgcagctgaggttagcatcctaccttggcagggcaccaaatgacttggggccagggtccccatgtcacattcttacttagatggagccctgtatgaaacacaccacagaactcacatttacttacagctgggggaggctgaccacttcgtgtgatgaggttggaggtctctgccacctccctgtgtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatcatgttggccaggatggtctccatctcttgacctcgtgatctgccggccttggcctcccaaagtgctgagattacaggcatgagccaatgcgcccggctggaaacttctgtaccgcaggtcaagcccagcaggaaagtgagaactgctcttttctttatttctttctgtcttttttttttttttttgagacagagtctgactctgtcatccaggctggattgcagttttgcgatctcggctcactgcaacttctgcctcctgggttcaggcgattcttgtgcctcagcctcccaagtagctgggactacagttgcacaccaccacacctggctaatttttgtatttttagtagagatagggtttcaccatgttggccaggctggttcgaactcctgacctcaagtgattcacccgcctcagcctcccaaagtgctgggattataggcatgagccatcgcacccagcctagaacttctcttctcttctcttttttctcttttcttttctttctttctttctttcttttttttttttttttttttttttttttttgacagagtcttgctctctcacctaggctagagtggctggagtgcagtggtgcaatcttggctcactgcaacctctgtctcccaggttcaagtgattgtcctgcctttgctcccaagtagctgggactacaggcatgcgccactatatccagctaatttttttttcctcttgtatttttagtagagatgggccaggctggtcttaagctcctgacttcaagtgatccacctgcctcagcctccctaagtgttgggattacaggcgtgagccactgtgcccagccgaactttccttttctttccatttcttggtatttggaaagtgaatagccatggagcagccagtgttttcagctggtgcaggcccagctggtatgttcgttaggcttctagctcaaggaagtgtccactctgcagtctcactggcatcccatcaccgtccagaagcaggatgccagctgtgtgtgctcatggcccatgctgagcctgtccttgggccactggtcttcctgtcggtttctccaccccttgtttcaggtggaggtccccgcccgactggcacaggaaggaggatggagagtggttaccactgtggttcgttgctgagtgagtttgatgttttaaggatcattgcccacctgccctgtggcaccatgtgctgccatgcaggggattcccaagtgctagtggcagaggagccttgtagtttctcaaagtccagcagtgggtagggcgtatctatgaggtgcttctcagtccagatgtggcaccttgaaattctgtaacccgcattctgctggttttctctcagagcttggtcttgccttgttgcaagcagtgcagtttcttgggggctaattgggcaccctcactgccttgttccaccaatagcagcgccccctgctgggggatggggagggttgggcacagcaagccctctgaggggccatctggattcatgatcttcttttgaaacttgaattggcacagtgaccagctgaggctacggtactctgatctaaaaactttaaaagtatgtgtggtaactgtagaacccagaaagtggagaggaacagaagtaagagaaccattccatgagagagaaggtctggtgtcctttctggttgtttcccatagtcaaggtcatgctatcctggggttttttgtgcagcatcttccacatcaataggggatgaaatgttctcctttaattagaaagccctggtcggcacgaaggaactcttgtcatacccctctgtgaatgtctcttgccatcctcagttaccatcttgttcttggaccttgtaataatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgcggaaacaggcctcttgagttcatgaatgaaattctgggattgggggcccccatgcaggcagccctccatgccctgtctctcaagcccatcttagagccgaagagaggcgccctgtcaggcccttgcagtactgtggtgttggatgtggtaaagggtagcctgggactgagtattctagaaaaattgctcagccttgtgctgtgcacacctggttctctttccagtgttatttatgtagctgagaagggcaatgtcacccacaaggggatttagcaggacacagcagacttctttttctcccctataaaaccaagacatgcaggcacagtggctcatgcctgtaatcccaacgttttgggaagccaaggtgagaggatcacttgagaccaggagttcaaaactatcctgggcaacacagcgagaccctgtctctacaaaaaaataaaaataaaaagttagctgggcggagtggtgcgtgtctgcagtccctgctactcgggaggccgagttgggaggatcgtgcaagcccaggggtttgaggctgcagtgagctgtgatgacagcattacactctagcctgggagacagagcaaaactcttgtctctttaaaaaagcaagaaacaggacagaatgcatctcattttctttttttttttttttttaaagacagagtctcttgctctgtcacccaggctggagtgcaatggtacagtctcagctcactgcagtctccacctcctgggttcaagggattctcctgcctcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccactgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggggtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgcttctctcataccatctgacttacttccaggcttttctcccttgtggaacgagtgccgttgagccctgctgcactctcagacgggctcctccgaagtgccgcaggtggtggtaaatcgactctcacccactggggtcgctccttcgtgtctccccccggtcggttcatctgttgctctggctgcaggaggaacgagtgagcttctggtcggcgtctgccatgccgtgtcaccccggcttctggcacctcctgtgcgtgcccaggattgtgaatgtgggccgtgtgtgtgaggccacgggtctccctgcagccactctcctgctggagctctgttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgcctaccaccgctgtgtccgccatcccgtcaagctccatccctttgggcagacagcccatggcacaggtatttacggggcagcgcccagggcacggctgggagctcggggcgtcctctgagcgcctttgtaaagcgcacctgtcattatcatcgccggtgacttcttttatggtggctttcagagtgccaaacccacagtccctttttttttttttttaaatgaagccaagcccagcttgtgcttgttgagaggatatgaataaatatctgggtcttttcagcttaaaatagttatactgtacgcattttcatggtaaaaataaaacagcagctaagcaaaagttttgctttctagagctgtgctatctaatagtgtagccactaagcatgtgtggctgtttacatttaaattgactaaaattaggccgggcacaggggcttatggctataatctcaacacctcaggaggccgagatgggaggatcacttgaggccaggagtttgagaccagcctggttcacatagcgacatactatctccaattaattatatacattttttaatggaaaatatatatataaatgtatatatattttaaaaacaaaaaaaaaacctaaaagtcaactaaaattaaataaaatgaaaaaatgcagttcttcagtcgcaccaaataaattttaagccctcatttgcccacagggaagctagtggctgctgcagtggacagcacagactccagaacgtggccaatgtggccaaagtggtattgggccatgctgttgtagagtttgatgtgtagagtgtgtaatttgtaacacagatcccctttctaggtagaggtagacttctgtgtacattatgcttttcagagacaggaattcccggcttcttttattgtatgaaatttggaattactccatggcatagtcatttttttaacaaatagttaccacatgcattctgtgtgccaggcactatgctaagattctgagaataaaattatgctgaagttctctcatcatacaggctttccattttagtgggtttgtcgtgaaaacatcaaatttgccaaaagaactttacaattcagtttctgttttaggggaaatgcctctataatcctagcagacagtggtccctgtccatccctgaacgcccaggtgcaggcactgccaccaccctggcttgtgcagtggcgtctctgcagctctgttctacacaggaagaagtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttgggggtcaggaattaggttgtgtggctgtggtggaaaggaggccagtgtgggcagaagccagggtgcagttccccatggcctggaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctcccagcttcaagcgattctcctgcctcagcctctcgagtagctgggactacaggcgcctgccaccacatctggctaatttttgtatttttagtagagatggggtttcaccatgttggccaggctggtcttgaactcctaaccttaggtgatccgcccgcctcggtctccaaaactgttgagattacaggtgtgaaccactgcgcccagccttgtactgtgtttttaaagcaggtttgttcatgcttgttagctgcaagaaaggaaactggaaggagttgagggagggagaaaagcgaatagagggacaccctggagtggaagcctccctactgcccaggcagctgctctgcagccctctctggtcctggccttccccgcagagggccctccccagctcagccctctacgtccggctgcagtaccaggctcttggtacagtctcccacacctggctgtgggccagccttggggacgtgaggcatgctgggccccgtgtaccaagggcattcacctgaccacaccaggtggctccagaggtgtgcctctgcttttgtgtcagtatctttcaatccagtcccttccgagaaaaagagagcttatctcaggaacgtatctgttgatctcaccaggaattgccccactgtgtcccatctgagctctcaggggccagaacctgctgtctccagtgtgtccagatggccactctgtggccactgtccctccagccacttgccctcagcagtcagcaggacacagtctggagactacactgcccatttgctcttgctctttccttgtggcaacaaattaggtccaagaaaacaggtggagctgaaagagggaatgtacgtgccccatgggctcttctccagagggcagggcccaggctccctccctctgtcttgacggctcatggctgcatcttcctgttacggtgggcatgcctcacggactcaggctaccaggtcaagcaggattctgtgctgggtgcattctggacacagtgctcagcacgggggcccagggggtggcatggcccatgccacaatcctcccttggcagatgtaagcaggcagtgtctttctcactaggggcttgtcctttgactagagaggcactgttgcctccctgttccctgctccaatcccagacctgacatgagaccaaggactgggaggtttctttctcgcctctctggctgcctccccagagcctagagcctgtctttggatgagtctttgcaggggctgcttctcatcccaggtgctggacttggactgcccaccactgacacctgggcacagggcctggcttcctgctctcgtgctcttggaaatgaatgggtgcccttcatttgtttttcttcccactagaaatctccctgcctcccatcctctgggctctgctggctgccagctgccagggtgagacccgtgttccactgcaccctggggagtgcctccaggggacacactgagtgccggagccaggagcaaggaacggttcccagtatgtgggggcgggggtggggatcgcgcagtgccgccagccttgcctgagggttcctctgtgagatggagctccctggaccagcctttttgccctcccacctcctctctggcccactcggtgtccacctgccttcagctccaggctgctgtgtgggtccctttcccagaaatgcagttcaggccattgttgctggggtggtggtgttgctggggtgttgatgtttagcgtgcctgagctcccttcatcactaggatgaccttgagcaagtcacttccctctgagctccctgttcccaacctgtgacacacaggtgacaggtggtgtgcactcagaaactccttccctaggatgtgtgacattcttgtcctggggcctttgctagctgtgacacaccggcgcccgacctctctggctgcctccctaatgccagttgtgtcttcagatgagtctttggggggctgcttctcatcccaggtgctggacttggactgtccaccactgacacctgggcacagggcctggctttctgctcttgtgctcttggaaatgaaagggtgcccctcgtttgtttttcttcccactagaaatctccctgtctcccatcctgtaggctctgctggccaccagctgccctgacctggggcagctgaagaactgagatagacctaagttctgggtgggtgcttggaggccccacgggcgtggctggtgagattgccgcttcagggccaaagtgggtgccgggcttcctgaggttcgagagcagatgagaactcttgagtggcaatgagggctgtgtggtggccttctctgcttggcagcctctgcccagcctgcagctgccttgctcctcagagaagcgctgagctttaggccacagaaaagagctgaccatcttctagaagggacagctgctcaggcacaggcgcctctctggaagaggcagtcaggtagaggcaaggggaggggccctgaccttcaagcaggaagagaggtgagcttgtgagacagctttctggggtgcaggtagagagtagcagcaagtcaagcatgggtcagaaaaggcagagttgggctgagcatggggcccagagtctttgcttcccactcctcggtgccgtctgtggttctctgtatggaattttctggccttgggattttgttgacacctggataagtctagaacatgtgttccggtgtctgggacatgcccttactcctcttcagctagggctctgtgcaccccagcaccgtgaatgcacaggactttggtgggagaaatctctgtacttgttcaactcagcatttagcaaatgaagtcacatcagtccccgtttctgaccttgctaacctttgcgagaatcaccgcgagccattttgctccattaggtagagtgatgaggcccggcaggccgaggctggggctcctgcactctgtccctcctctcccaggcagaggtgtcttgaccacaaagcagtgggaacagtccattccatcggttgatgtcccactgggccagtggctttggatagggacctctgacccagctgtgctggaagtaccctgttgtggtcacgctctgtgccttagccccccaccccctggtctcccagcacacgtggttcaggaacggcctgcacccagcatcccttgcagcactgtcaggcacagcccatggaacaggcaggacagaaagagcatttcgctccaggagcttggtccacgtggtgctgaaagggcagtgccaccctgccctctgctgcctggtggggtggtgaggagggcagcattctgtttgtgggctctgggcctggtccccaatttaaggagcttagaaagcagctgtcctatcccagtactcacagcactgtggtggaagtgcttggggggtggtgtgagccgtggcccgagacaggcgttcatggccagagtgccccaggagaagcactgagttggtctacagaaatggatggtccaggggcctggctcctaggcagactgtgaggggatgcttggcatgcagggggttgactagggtgtgggaaatgtagcagggccttcagggttcccccagtgtgacaaggcatccctctttgctgagagtccctctaggggaggccagacgcccagggctggcaggcagctgttctccccatcaaagcagccatctgtgctccaccccaggaaggtgtgggtgttttacatatgcttatccctgatgcctgggtggtgtggtttcatccctagagtttacggatgaagacagtggtgtccctggtgcagacactggggtgattgatcttatttgtgtcgtggccagcaaggcctggggagcagagcaacagccttgctttgcatacacacagggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctacatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgctgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccgtgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacggtaggtagacccagaggagctgtctggggacccagggcaagcaggggtcattgtggaaaaccaggcttccactgcagcagggacagcctctgtgtgctcctgcccctccccagctcaggcccctccctcccctcttctggctcctcctgcacagacagcagcgggttttccagtggtcgcctgagagaaaagggtctctgctcccactgtgtcccttcgccccttcaacttgtgtcacgtcagctgtccagggtggttgtgttcagtgggtgaggggtgagtaagcccatggctcagggacagtccccgctcttcccagaggccactagcttcccagaggccactaccttggcagggctgccaggttccactggtagcttgggcacacagggcccaatctgggtgctgtggctccagagagaaccacggtggcagggggcagtctctgagcccagagctggcacacagcagagctggcacacagcagagctggcacacagtagagccaggctgggtccccaaggttgttagaggcagagccctagatcctgttcagatttggttctcactgacgatgaggctctgggaggagagcccaaaggccgggcagcgtgcaggacacatcacctcctggtgcttcggcccgcgcctggggctaccccttcccagagcactgccgggtgtgccaggagcgagcgcagcgccggccgccttaggttcacgcccactgctctgttgcagacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcatcactgtgtccccttctccatgaatctgggctcgctgtcctgtcaggatgctgtcagccttggggctgcctggggcctctgcctcccttccaggagggacttgaggtgctgcagctgaaaggcaggggcaggggtgtggtggggcctgcggtggcaccaggctgcccagggccatccccaccacccagggcctcacctcttgggcctgcagaaggttggtattccacagctggtggatgaccacttacactgctgaagtgtggtgggctttcgcaggtgtggggacaggatcatcggggagtgccatcatctgcctgtccctgtgctggctgcccacccaacagaaagccctggcgttagaggcctctgcttccctgtctctgaaagtcattacagtagccagaaatgacctgcccaggtgggtctgagcatccaggcagcatacttcccccaggcagtgcccaggccagtgtggggaacagggcctggctcccttctcccactgaccagagtgctctgggtgccagatgggggtctcggactggggtctgtcccttcctcccctctgaaggtgccctgagggtcagatgtgcttcagtgggtgaccagctagctgccaggctgcccttagtcaggaccctatacccagtggggcttcttgcttcagggctggtctcaggggacgtgcagagatgcaggagcctgtcctgctggttgcaccgctcaaaatgtgcactctgcaatgtctcagggcagcccggcaactcggggagtaccagagcctggtcctgctctcctagtcccctccaaaggcaggctgtggccaggggcagcaggcactgaccagctccattctaatcaggcccaggaacacaactcacttttcttggtaaaaagattactttgttttcttttctctgagaaagtggtttaggggctgttgctgccccctcttgtgggctcaggtcagcacaggtaatctgcaggactccaggggaggggaggaagacagcgcccacccaatggacagagtgtggacagagcgtggccattgtctgctttcatgagccctggagacaggatcctagagcaagggacacagcagtttgctgactgcagtgtgggagcctagtaaatgtggtcctggggcccttagggtgcaggcaaaccttacttggactgcccttgcaccccaggaactttgtccagcttgctgttgtgaagcagtggctcctcctcaaggtctgccttctggggtaccttagagtaccccagtgctttagagtcttgtttcttgaaggaaccggctggggcctgtcctttccttgagagttggctgcaggtcagacccgacagggccagtcactgcaggcaccaacagccgctgcccaagtctttcaggatcagctgtgtgtgcccaagaagcccctgcctcagttgcctcctctgtaaagggaagcctgccttggagggttctaggaggaataaatgaggttctgaggatgaagcccatgggtggtgcctgtgaacattctagaacagtcaatatagtggaagctggctctgttttgggtaaaataaaactgcatgcgaggcctgggactaagcctgcatgggtttcctctgcaaggacaacgcccatggcacgcctgggctcatcacaggaacaataggggccagggttggggccaaggaagatgcctggtctcgagccactccccgctcactctgcagaagatgccatgagcccagggctccgtgggcagtgccatccctcctgtatcctgtctgcttgtggagggggacgtgggccaagcagggcctctgccaggcagccagtgtacgtccttccccctagaaggccacccaaggaggccccttctgaccgcttgctgtgctggcttggggtgcctgccatgaggccttgctgccctgcgttgacagcccctgtgactggcccccagtcctgcccaccccaccctaggcccctcctggtggtttcagcttacagggctcccttcagctgcccgttcacccccaaatccttgaggttggcccagcagaggactttcagctccctggtcagcacctctagtgaccacccaggctggggtccctgtggggcacttgcccctgtgagcacatggaggacaccagcctgctcacctgacaccatttaattcgaggtggagttgacaggctggaagttgccacccgcacacctgcctgagggagaagccctccgtctgcctgcaggcctgtgtcctccctgctctacccacactccactgaggcagccccagacccaccgcgcgcccaagggagcagaggccccggaaaggttgtttcctgaggggccatccagaaagcgggagggcttgggacccatggagcagcaggtccggagggagagcatggcctcttcccgtgtcctgtcagggtccccagcactgcagggccacactttgcccagaacagctcactggagttgccaccgcagctagggaagggccttcactcaatcccattctctgtgtctccctagaagggagagccctggacaatgccccagctgggatgttcccaggctggtcccattcaccagtcagatgtcctcctgatgtcagccccggccccaaaggtaatagagtgagctcaagaactcaaccagaatcctgggctgggtgggggccaccattgggatggggaagtgccttggacaagtggcagggaagcaggactctggttactccccccacccccatccccacagttgttgctgagatggcaggaaggaatccctggatggggtgtgcccggagcccttctcccagcgtatcaggaatcagagccacaaggctggagatcctaggcccagccacagcagcaatctgaggcaaagacccagcagggtaggggctgtcccagagtcccctcccatttcaggagctctgcttggaggagggaaggtctgggaagcaccctgtgcccaccatcaccactgcactgaccacagcccttgggcttcctgagagcagcacgtgctgtgcttggctgtataacatcgtccagccatggctaggggcagcagcatctgtccaggtccctcagaacctgtcctcactgggttggcatacagaggccagtgcagccaggtgggcaaggacagtctggaggggctccccggggtggcaggagcttcccatcaggcacgaaagggcccaagtctcacctttctcctgtgactcattcattatgagcttgtaatggggatctgaaatcaagcgcatgctcttctcatcacttgtgaagccacagccattctaagagaagcagcttgggctgtccactaccccctgctgaaccccgagagtcctggctcgccactggctgactgggccctgccccacaggtcccgctttccaccacacctttgctgtgggcatgtgagggcaggaatgaccctgcctgttccctaggcagagcccacccagcacatcagcctcatcctcccatctgactacaagacgcccatggtgccaggcaggacctgggccccaggggtacaggggtgaactctgggagcccctggccatggatgagcatggtcagtgtcatgatcctgtgggcatcagggactggggagaggctcaagaagacatggggaagggggatcctgacataacagatgcctggtgatggaatacttagcacctaggtaaggcagcaccagggagcggggagggagatgaggctgcaggcactggtgccctcgctggagcctctgctgaagcagggagggaggagcggagccacatcctggcgggccctctttctgctctggtgggcagtgggggtgaggagctgctaagggtgcagttaggaaggcccagcccgaggacagtgtgggcacaggcgaagccgggggcatgcctgctcctgatccggcatgtttagttggagaaaattcactcagttgtgcaccggcactgggcatgttttccttctacgaagtttttaacagatgtgtacctgaccctgcctggagaggggagggctggcagggtcagcgtttgaaatgatgctgcccccggcgggacaggcagacaaggagggcaccgccccgggcctaggcgggtctccgtcctggggcaggggaagagctcagcatggcaggacctagcgtgggcttgctgccctgtgtcctccctgagcccaggcaggtgctggagttcatgtgctgcgtttctgctctgcgggccgccgccgtgttcaggcgcttggggaggcagggcaggcctagggccctgtggctgggctcacccttgttctcccacttcagatgctcgatcttctagtggagcttggccagcaactccaaggactgctgctgtaggaactgcaggcccaggtccaagtccaggatctgcctctgctggtcgatctggacacccacagaccggcggcactgcggggggtgcgacgtaacctgagatcccggggaccagctgggaggctagctcgcacggctcatgtcgccacccccaactacacagccgctgccactgcaccctggctcagtggccatgctgcccgtcacaatggaaaggggcgtggctgaggagcagggtgggcagctggggcagggcctgtggctggctcttcctgggtgagtacagtctgatttaaaaggcacccagggctgggcacggtggctcatgcctataatcccagcactttgggaggcccaggtgggcggattacttgaggtcaggagtttgagaccagcctggctaacatggtgaaaccccttctctactaaaaatacaaaaattagctgaacgtggtggcacgtgcctgtagtccaagctacttgggaggctgaggccggagaatggcttgaacccgggaggcggaggttgcagtgagcagagatcgcgccactgcactccagcctgggtgacagagggagactctgtctcaaaaaagaaaaaataaaataataaaacgcattcaggcattctctacagcctgggcaacatagtgagaccctgtctctataaaaagtaaaagaaaaaaaattagccgggcttggtgctgtgctcctgtagtcccagctacttgggaggctgaggcaggaggactgctggaatcccggaggtcaaggccgcagtgagctatgatggcaccactgaactccaggctaggtgacacagtgagatgctgcctaaaagaaaaaaaaaaaaagaaatatgtctttctttacaaggcctgccctaaaaaaaaaaaaaaaaaaaaatgttcgccagagccaggccaactgtgattttaccagatgccaacatacccaacccaagggaggaagggaacatacccaatcccagcctgttctagctcctcttccccacatcttcctgccacatcaatagggctcctgtataataacaggggatacaagtgaaagaacagcccatctcagaacttatttgagaaatgtctaggaaaccctaaagacaacagggagacaaaaactaagacaccagaggaagtttatgcctctgacacttacagttagaacaaacagcacacatggcccaacccctaaccagagcaaaataaaacctcacacaggccgggcgctgtggctcacccctgtaatcccagcactttgggaggccgaggcgggtggatcacgaggtcaggagttcaagaccaccctggccaagatggtgaaaccccatctactaaaaatacaaaaattagcgggcgtggtggcaggcacctgtaatcccagctacttgggagggtgaggcagagaattgcttgaagccaggaggtagagcttgcagtgagcggagattgcggcaccgcactccagcctgggtgacaaagtgagactctgtctcaaaaaacaaaaacaaacaaacaaaaacttcacacagaaagcccatttatcacgtaccccgtacagcatgtccagctccccacaaaaaatttcaaggcataataaaaaccaaaaaatgcagtttgaagagacagcaagcatcagagccagactcaaatatggcagagatgtcggaattatcagaccaagaaatggaatacaactatgattaatatgctaagggctctaatggaaaagtggacaacatgagattacagacagaaaatggaaacagggatagacactctgagaaagaatctaaagaatatgtgaaggccgggcacagtggcttatgcctgtaatcccagcactttgggaggctgaggcagcggatcacttgaagtcaggagttcgaagaccagcccagttcgagaccagatggcaaaaccccatctctactaaaaaatacaaaaattagccaggtgtggtggcatgaacctgtaattccagctattcaggaggctgaggtgggaggactgcttggacccaggaggtggaggttgcagtgagctgagattgtgccactgccctcaaatctgggtgacagagtgagacaccaccaaaaaaaagaaaagaaaagaaaggaaacaaggagaggaaagaaaggaaagaaagaaagaaagaaaagaaagaaagaaagagaaagagaaaataaagaaaaagaaagaaagaaggagaatatgtgagaagtcagccaggtagtgactcatgactgtaatcccaacactttgggaggctgaggtgggtggatcacttgaggtcagcagttcaagaccagcctgggcaacatggtgataacccatctctactaaaaataaaaaaattagctggatgtggtgtcatgcacctgtaatcccagctactcaggaggctgaggcaggagaattgcttgaacctgggaggtggaggttgcagtaagctgagattatgccactgcactccagcctgggcagtaagactccgtctcaaaaaacaaaaagaaaatataagaagtcaaaaacacaacagaatgaaagatcagggctggcagcagtggctcatgcctataatcccagcactttgggaggccaagttgggtggatcacctgaggttaggagttggagaccagcctggccaacatggagaaaccccgtctctactcaaaatacaaaaattagctgggtgtggtggcgcatgcctgtaatcccaactacacagaaggatgaggcaggagaattgcttgaacctgggaggtggaggatgtagtgagccgagatcatgccactgcactccagcctgggtgacagaaggagactctgtctcaaaaaagaaagaaagaaaggtcaggtgcatggctcatgcctgtaatcccagcactttgagaggccaaagtagaaggatcgtttgagcccaggagttggagaccagcctgggcaatatagccagaccctgtctctacaaaaaattaaaaaaattgccagcatggtggtgcacatctgcagtccctgctactcaggaggccaaggctgcagtgagctgtgattgtactactgcactctggcctgggtaacagagagagaccctgtctcaaaaatggggtaaaatggtataggaaatttggatctaaaaaaaaaaaaaaggaagtgcattagataagaaataaatgaagataaaatagaatcttttttttggtgggggtggggaacggagtttcactcttgttgcccaggctggagtgcaatggcacgatcttggctcaccacaacatccgcctactgggttcaggcgattctcctgcctcagcctcctgagtagctgggattacaggcatgtgccaccacgtccagctaattttgtatttttattagagtcgggggttactccacgttggtcaggctggtcttgaactcctaacctcaggcgatctgcctgcctcggcctcccaaagtgctggaattacaggcatgagccactgcacctggccagaatcttgtattgttcttatttttagttgaacagatggcaggttattcaaaataattatatcaacatgtattcagtaattatagcttatggatagctggaatgaatggcagcaatgttataagggatgggaaggaggatatcctgagtggaaagaaagtcacccaggctggagtgaagtggcacaattatagcccacttgcagcctgcaactcctgggctcaagccatccttctgcttcagcctccctggtaactgggattacagacacacaccaccatgcctggctaatttttaaattttttgtctcgctgtgttgcccaggctggtctcaaactcctgggctcaagaaatcctcctgccttagcctcccaaagtgttgagattacaggcgtgagccactgtgcctggtttatggttgcttttgaatgtcctagtcctacataagtggcttccaagaagggaaaaagaaaaatgcaggcaggaaaaggtgctgatccataaaaacctctggaaggtatgtctctagggagggggtgagtgttgaggagggatgttgcaaacatggtagtggagatggcaagagtggctgcctgcctcttcgtctgcacttccacaatctgaagcagccatcatcaatcggaacacagatccccagtatttggaggatggggctcttattgcctgctgtggctcctgcaagctatagggaagctaccccagaagtataggcatggctgcttgcaccaccaatttaaatgctaattacttctgaaaacaccctcacacacatgcccagaaataatgtgtaaccagatatgtgtgcatccagtggcccagacaagttgacatatagaattaaccatcacaagtccaccccttgtcaacctggtacctacacacatctccttaaaccatacttaacctccaaataaacacaataacaaagtcagtgttagcagtggaaggtgtctgagttagtggcagcgaatccgtatgggtctgcagcaacctcaattcttgcctcctcagaaaaaagaattcaactggccgggcatggtggctcacgcctgtaatcccagcactttgggaggccaaggcgggcagaccacgaggtcaggagatcgagaccatcctggctaacacggtgaaacctcgtctttactaaaaatacaaaaattagccgggcatggtggtgggtgcctgttgtcccagctacatgagagactgaggcaggagaatggcaggaacccaggaggcggagcttgcagtgagccgagatcgcgccactgcactccagcctgggcgacagagcaagactccgtctcaaaaaaaaaaagaattcaactgaggggcataaggcagaaaaagagaccgaggcaagttttggaggaggagtgaaagtttatttaaaaaagctttacaacaggaaagaaagtattcttggaagagacctaaacaggcacataaaggtcaagtgcggtgtttaaccttgattctaggactttatagactgacccctttcccaagattcttcccctagggtgggctgcctacatgcacagtgtcctccttacccttgggagatgagcacacgcagtgtgtttaggaaactgtacgcatgcccatctgaagatttcttccgtcccagaaggtcatactctgccattgtctcttaatgcacatggccggggaaattgcttctccctggtgcctgcattcaattaacactttaatgaaacaggtgtgacccatcaggaactggcctctccctgatgccagctgccaatttatcactttcatttttaatttattttttagaaggagtctcactctgtcacccagactggagagcagtggcatgatctcggctcactgtaacctctgcctcccaggttcaagtgattctcctgcctcagcctcccgagtggctgggattagaggcatgcaccaacatgcctggctaatttttgtatttttagtagagatgggctttcaccatgttggccaggctggtctcgaacccctgatgtcaagtgacccacccaccttgacctcacaaagtgctaggattacaggcatgagacaccatgcccagccctggctttttttttttttttttttttttttgagacggagtctcgctctgtggcccaggctgtagtgcagtggcatgatctcgcctcgctgcaagctccgcctcctgggttcacgccattctcctgcctcagcctccagagcagctgggaccacaggcgcccaccaccacgcccagctaattttttgtatttttagtagagacgggatttcactgtgttagccaggatggtctcgatctgacctcatgatccgcccgccttggcctcccaaagtgctgggattacaggcgtgagccactgtgcccagccgctaattttttattttttattgtttgtagagagggggtctccctatgttgcctaggctgttttgtttttttttttaaacagagacagggtcttgctatgttgcccaggctggtcttgaactcctgggctcaagcagtcctcccatcttggttttccaaagtgctaggattacaggcatgaaccaccaggcccggtctccactgtgaatcttttttttttttttttgagactgagtttcactcttgttgcccaggctggagtgcagtggcaccatctcggctcaccgcaacctccgcctcctgggttcaagcaattctgctgcctcagcctcctgagtagctcagattacaggcatgcaccactacgcccagctaattttttgtatttttaatagatacaggttttcaccatgctacccaggatagtcttgatctcctgacctcatgatccacctgcctcagcctcccaaagtgctgggattacagatgtgagccaccgcacccggccgctaatgttttattttttattgtttgtagagacagggtctccccatgttgcctaggctgttttttgttttgttttgttttgtttaacagagacaggatcttgctatgttgccaaggctggtcttgaactcctgggttcaagcagtcctcccatcttggtctcccacccaaaatgctaggataggcgtgaaccgccaggcccggtctccattgtgaatcttttttttttctttttttttttttgagactgtgttttgctcttgttgcccaggcgggagtacagtggtgcgatctcggctcaccgcaacctccgtccgcctcctgggttcaagcgattctcctgcctcagccttcctgagtagctgggattacaggcatgcgccaccatgcctggctaattttgtatttttagtagagatggggtttccccatgttggtcaagctgatcacgaactcccgacctcagatgatccacccgcctcggcctcccaaagtgctgggattacaggcatgagctaccgcgcccggtttaccattttgaatcttaagaggacaaagtctggttctctagaaggcccgagtagcttttcccctgagcatcttgagaaaaaagtgctctgagcactccttgggaagtccgagacagcacatgcagccaggtgctccctggctgctctcccagaggtcagcacagctggaggcagctggagggaggaggctgcagaggcgctgaagccaggaagacccaacagtggagagagaagttgcctggtgactgaccctcggcttgaccctgtgctcccctgggctgagctgggtgtcaaaaggcctccaccctccaaagtgccagcctcctgctgtggctggaaagcatttgctcctcctcctcttctcacttctttgcattcttctgatctcttaagggcgtacaaagattcacatggatattaaagtcaatggtgattttcatagctggaatactcgttgggagaaagtaggaattcttttttttttttttttctcccaagctcaagcgatcctcccacctcagccttctgagtagctgggaccacaggtgtgagcctccatgatggcctggctaattttttatatttttagtagagatggggtttcaccatgttgctcaggctggtctcaaactcctgagctcaggcgatccacctgcctcggcttcccaaagtgctgggattacaggcgtgagccactgtgcctggccaaaagtagaaattcttgattgggaaataattttatatatttcggccccttctcacttgggaaaattctgctaagaattctggttttgagagtcaagggaagctagcttaatttttaaagtgaaggctacataagagtcctctctccagtgtggtggctcacacctataaacccagcgcttcgggcaaatcacttgagcccaggagttcaagaccagcctggcaatgtagtgagacccctatctctacaaaaaaatttaaaaattagcagggtgtggtggtgcgtgcctgtagtcctggctacttgggtgggatgctgatgtgggaggattgcttgagcccaggatttggaggttgcagcgagccatgatggtgcattgcactccagcctgggcaacatggcaagacctcgtctcaaaaaaatacaaagagtcctctctatgttggaaatgtcagagttattggccatttaggggatctaacttgctctttgatgtccaagaggaaaggtatagagttctcctgattacacagggcctctgcttgtgggtcgcctgcatgaggcgatcagaatctgagtcacctgggatcatgtgggtgctggtacatcctagagataggatgtgttggtcatggaagagagtgggccacaaatgggttccaggggaatagcgttgcctggtgcaaggagggggatgtggaggtgcagggagcaggggtggtgtctggagagcctgaagctgtgctgccagaggctccaggccatgaggtctgagaagcatctagatttggcctgttcacagcagggaagtgtggtccagtggcaaaaagttgagggcatcctaggagttgaggaggtggtggcggttagagtaaaccactctggaggcgtccggggtggagagacgagaatgtgcaagaactcctgcctctagcctggcctcctcaggaccccggccaccagcctccctcctagaagtccccagagcttcctcctccttgtgccccagaactggttcctgggttgctccaaccccagaccttccctggaagtcccccccagtgcctcctggctgggaacccccaactgcattttgcttctgctctcgtgccagtagtccccttttctctccagtgtccaggccccaaccaccaagaccctgcctcctcacttggctttgctgttcttagttctctactcagtaggttgtgtctgcctccattcctggccagacgctgccctggggctgagtgcacagtccccagccactcccgagatcctcagagcttctggaagccacagacatggtggcatatgtttcaggtcgtcagcttgtttttttttggagacagagtctcgctctgtcgcccaggctggagtgcggtgacgtgatcattcactgcagccttgaccttctgagcccgggtgatcctcccacctcagcctgtcaagtagctgagaccacatgtgtgagccaccacacctagctttttgaatcttttttttttttttttttgagacggagtctcactctgtcacccaggctggagtgcagtggcacaatcttggcttactgcaacctccagctcccaggttcaagtgattctcctgcctctcccgagtagctgggattacaggtaggtggcaccacacctagctaatttttatgtctttagtagagacaaagtttcaccatgttggccaggctgatcttgaactcctgacctcaggtgatctgcctgtcttgacctcccaaagtgctgggattacaggcgtgggccacgcgcccagccaactttttgaatcttttgtagggatggggtcttgctgtgttgcccaggctgggcttaaactcctggactcaagtgatcctccctgccttggtttctcaaacttctgggattacaggccaatctactcaacgttgatattgagtagaaggcaaaattcacatggctccggcccagcccctttctgtctcaggcacttcagtgttaatatgcgccttggttttgctgctgccgagtctactgtgcccctgggcaaggaaagcaaaggaaaccagagggccaggcccgtggacactggggtgaggggccaacagggtgcccagcagttgtttccacagcccccacgtggtcagggaccctgtatgggtgaaccgcctggatactgagcctaggcggcggaaaactcaaaagcaagggcaggtttattcagatccctggtggagttacaagcttggtttggtttttggtcacaggccctaaaatacctgtattctgagtttacataaaaatacaaagcactggccgggcgcgctggctcacacctgtaagcccagcactttgggaggctgaggtgggtggctaacatgaggtcaggaatttgaaaccagcctgactaacatggtgaaaccccatctctactaaaaatacaaaaattagctgggcatggtggcgcatgcctgtaatcccagctattcgggaggctgaggcaggagaatcacttgaacctgggaggcggaggttgcagtgagccatgatcgcaccgccgcactgcagcctgggctacagagcaagactctgtctcaaaaaaaaaaaaaaaaaaatcaccaccgagacgctgttctccctggtgtgtcatctgtggggtgaatgaaggtgtgagataccccgtggtggtttctgtcagtgaatctgtagttgtcatatattttgaatacttcaatatcatcgaacagttgctgtgtctttaagcactagattttattgaagctaccttcttccctttttagtcccatttcccctagatgcatccacgactgcaggaacccccctgcccccaccaggagcccaaagataaccatgttcccacctggagtggcctcccacctccaatgccatcagggctggtgcagcttccccacctggtcagcaacatcatggccaaggagtagagggcgtagcccagggtgaacagcagtgcacaggtgaggggcctgatgcagaacagagaggccatgaagaaagccagcagtagccagggcagtgtcaggtagctgcctaggaagtgcaggttgagcctgtggccgctggccagcgtgggctctgtgaggtggtagcaacagaagctggcaaggaagtcatctcaggaacacagagccgccatctggtctgcaaactgaagcgcaggcagtggcacgggggcatggggtggtggcaccacaggcctcaggacagctgcaccccacccccacaggccaccctgagactgcaccccaggcaggagcacccagaaccctctctgaagaggccaggccagccctcctgcccactcactctgtgtttgatggcagatgacagccggaaggatgctcagaccaagctggtaatctcataactccagaggggctgcagctccgggtccccctggtactcaatttcaaacctttgcagcctgttgatgatctagaaacccaggctatagggttgggccagaaaacatggccctggccaggtgcagtggctcatgcctgtaatcccagcactccgggaggccgaggcgggcggatcacaaggtcgggagttagagaccagcctgatcgatatgatgaaaccccgtctctattaaaaatacaaaaattggccaggtgcagtggctcacacctgtaatcccagcactctgggaggctgaggcaggtggatcacgaggtcgggagatcaggaccatcctggctaacactgcgaaaccccgtctctactaaaaaaaatacaaaaaaaaattagctgggcttggtggcgggcacctgtagttccagctactcaggaggctgaggcaggagaatagcgtgaacccaggaggtggagcttgcagtgagccgagattgcgccactgcactccagcctgggctacagagcaagactccgtctcaaaaaaaaaaaaaagttagccaggcatggtggcatgtgcctgtaatcccagctattcaggaggctgaggtgggagaatcgcttgaacccaggaggtggaagtttcagtgagccaagatcatgccactgcactccagcctgggcaagagagggaaaccttgtttcaaaaaaaagaaagaagagaaaaggaaacatggcccctgcacacaactcagaagagccaagccatctctgctcacaggggaggagggagctggggacacgtcagggcccaacccatgcacctctgggacttgggcctctcacctggtactggcccaggggcgtggggatgagtctgtcctcacccgcgatgcagtccggagctgcttctttccattctcatcctggatggtgtccaaggcaagtgtgagagactctgcgtgagctgcacttcactgagctaccagagagagagaagctcctctgccctcagtgtcaaggcaaaggaacaccagtcttcaccccaccagcctctaacagtggcaacgagagcacccggacatgacactcggggtgtgggcctgcctcccacaacaccgggttcatctgcatggggcctgggacggatgcatgctgaccatgggcaaagggggagtggatccttcggggaaggggaccctaacggccgtggaacaggccccattgctcatactcggaatatctggcgcaggtacgccagggcctcctccaggcactcgtccatcttctggacgctgtcctgccccatctcgcccaggtcatggctgaataggagccgttggtgtctgtggggccaaagcccagccacaacaggaaggagtggccagctggagtctccacacactggtccgagatggacctggccgtgtgcttggcctgcgtgatgagctgagtaaggtgcaggacctgcaagggaggcgagggcaggtcaccggcaggatacgcctgtactgccacccaggcaggctggctgggggccctaagatgggtgcacagccagatcactgagtgacgggaggagcagcttctgctggaggacttttaaagactaaagaatgatcttctaaatgtgaaatttcccaacactgccttcgttatcagaaacaaatcagactttactgaaacggggaaaggagatgtgcgtcaactctccgcccaacctccctccctcccgccagaacacagcacttccctgcctctgctcagccttgtggctccaggggtcctgtgaaggggcaccgccaacccactcaccagggtgtaagcctcgggcccgaacatcgggtgtacttgcagtcctggccctccaggccatagatgtgactcttcacattgaaggaggcatcagtgaccactggtggccactatgacaggatgctgctggcgaatgtgcaggctgtgaagagtcggtgctggcggtagggggatgacgagctccggctccgggaacagctgctcgaactggaaggcaggagacgaacctagcgcccacttccgggggcacagagaacctggttgctgcccacaggttttcaggatgcctccgaggtatctggggagccatgacccaggggtgtcctcctgaggtcctgcccagcagtgtctcccatgtagcaggtggccgacatggggagggcaaatgagggagctggtggctcacagagcccccgacagtgtctgcaggagggcaaacaccaggaggagtgacagaagccaatgtccaacccagccaagacaaacgcatgccagagaccaagaccgcctcccaaggatgctgccacgagttgccagggagaaactgtggtgccatgggcccgcagcttggtctgtgcagaccccctctgtgggtatacctgcggtcttccacccagtgcctggtgcctggtggctgcagggcaggcagggtccagccggtctcagccttaactgtgcagtgttatggatgacagctcaggagactgttggcaggcagggagggcaggacacaggcaggtgagacccaggccctctgaggttgctgcatccttagcaggcctgaggcccctttccaagaggactgaagccaccatggcagaggccagcccagagcctgagggggctgagggaggatcccccagagggtccaaaggggaaggcctcgggcaaggaaaggagaggtcagtggccacgccaggtgccatggaagcctgggggggtctgctgtgaggatcaagcaggagatgaggggaaggtggccactggtctgctctgtgctggtaaggaagggttaaggaacagtttgggggtcaccatgaaaatttgtctgggccagaagggagaggggacaggtcacccactgcttccatgagaaacccattctagggcctggcgaagttgagcctaggaagggctggtctgtgctccactcagcagcagctgggagagggccagggccaggctgaccccagcacaggccgctgtcttggcctccacccactggagcaacatttgcccaggggagccagtggcatgtgaggagagggggccagggctcaccatttctcagacacactggggctgggagttgctgctggcagcctgcttgtcagctgcataccaccatggctgcaggtagctcagccacacctccaggacctgtgggggaggtgtgtgctgaaggcccagtggctggggccaaatcctctgatggcctggaacccaggtacccaggtggcagctaagttggctcttcccacgtcccccagagggcgcaggagagacgcgcacagccctgtgagatttggttctctcactgctcttcagaagccagggtcatgggcgggctcttcccggcccacgggacccagtgctacctggttgcgtaagagtagaaacctgtctggcaccagacaggtgggatggggcagggctttgctgtgcctgagggttgcctttggaaactgaaacagaaagaacaacgtggccctccaaggccccctcctctccaaggtctctgtgacaacacttgttctccttcatccaccccaggggacctccctcattggggcacacagaagacacaggcacacatgtgatggggccgacactcctagctctgaacaatgcgtccaagggccagtggccaaagcaatgccgcaggaagaggtagagtttctgctggactaacctcgggacagcggcctgcagaggaggggagggtcaccagccgcttgcacagtaaggtggccctgctcacagatgagcccggggttcccattagtgagggttggctctgctgggagagagcactaggcacttctgagtggtaagagctggtttcagccccattcttcagaggaagaaaccgaggttagggagcatcccgaggacacagcatgcaggcggccaagccattgcatctcctgcacacacctcacctcagccccacacaaaacagcccactctgccagccccgatgggcctgggagtcaggacccgccccaacccttctcctgacgggtggggaggagcaagagacggcaccgtgatggggcctttttggccagtctggagagagaggctctgggagccagagatcagccggcagccccaccaggctagctgagaaggcacttgcgtagccctccagaggcctcacgtgctctgtgagcaggaagggattcccctcaccctgccccccatgccccggggagaggtcgccgtgggcaacaccggaggaggggaacgaggaggagacagcagcggctggaagccgcaagggccacccactgtttgaactcccccagcgggctggtggtgtgggagtggacgaaaggtgagacctgctctggcttcaggctgtcggcaaaggcgtgcaggtgcttcagtggcaggcgcaccaccagcatgtgccccttggtgggcatgaacgactcctaggtggaggaagaggagtcagggcctgggaagggctgcagcacgtggcctccaggtctgaccacagcccgccctgggacagctgatctgcctccacacaggaggcacgagccaggcaaagagtggggccaccactgtgcctcacacccagcgggtgtgccttgcactgcttggtctgaactgcgaccagctcgtggtagggaagtgcttggcccagcgcccacacagcctacctggggagaactcgctgagacagacgcatctgcttctgcaccgctgcacacccgcggtgggtggcacagggctatggcccgccagactgtgcccttggccattgctgcctatcttgatcctcatggcaggaggaggccgatgtcacccccaagctctggatccagggtctcccagggaagatggctaaggccaggaattcgagattcgcttgggcaacatagggaggccctgtctctacaaaaattttaaaaagttagctgggcatggtggtgtgcacctgtagtcctagtgactcaggaggctagggtgggaagatcgcttgagcccaggtgttcttggtgcagtgagctaggatcgtgccactgcactccagcctgggtgacagagtaagaccctgttcaaaaaataagaaccttcacttttctccccaattccttccatctgctcctcattctggacacagctggatgagggctcaccctgggagaagcgctgggcatcaattcctctgttgcccacagacctgtggtcaggaaaaccccaagacaagagcacagtcaagctaacaggccaagcttttgatttacaatgtacaagcaggatcctggagacctacacccaagaggaaagcctttttgctggctgtgggctttctctggttgctcagcattgagagggcaggggggagcatcaagagtggatgagggcaggagaagggggcactgagggtgggcccctgagtccgagtggacatgctcgcctctccatgcttacccccagccctttgggcctcaacacatctgtgatgctgagactggtgcagggcccggcctctgggtatatcctgggatgctgcagaacccacatggaccactgctcacatcactgcccactcaagtctgcccgtcaggaaaatgtccccacaggtccaggagacacaccccacagatcagtggctgaggctgggaatggaggtattttcttcttcttctttttctttttttttttttttttgagacagggtctcactctgtcacccaggctggagtgcagcagcacaatgtcggttcactgtaacctctgcctcctgggctcaagggatcctcccaccaaagcctcccgagtagcggagaccagaggcacataccaacatacccagataatttttctatttttttgtagaggcaggggtctcatcatgtttcccaggctggtctcaaactcctgagctcaagcaatctgccttccttggcctcccaaagttctgggattccaagtttgagccaccgtacctggctattttcttctatctctatctttaagtatttaggcaatgaatttgcattgctttggaaggaaggagaaaaccagtacctatacggcccgactagaatggtactagtggggtgggaagttagaccagggtccttctcctccagtctcacccctggccctccctctgatcctggcctgggatcctgagccatgacatcctccctgcagctcacgggaggggacagcatccacataggaactgggaacctgccttcccctgcaggttcacttacccaacatcacctggtccttccagagggtctggaggggccagtgtctgcccctgcccccagcagtcacatgaaagcctctcaggctattttcccacagatttgctgagccaaacttttccctcagctctgtacccctcctgggccacattcccatgtgtagtccctggccacagtcacacctgcttgcttctcaaagatgtgtacccaaagccccgcatttcccactgggcccagcctcacagcacctcagctcactcctccagggtctccctggtcacctgtcctgccatgggggttgctagatgcttcctggacactgccctggcccaagccctcatgtccctcttctccagtggctcctgcggaacagggacgccatcacatgcagtggttgccatcccaacccaccggcacttggggcccacatgtttttttcatcttgcgctcaaattcccattcaatcacgtgtgctccttcgcagggtgaacgggacagacccctggctgtgggcacagctcgtctccccgggctctcacagactcactaactctgtcgtccccgaaatcccccatgggcctgaactctgcttcactgacctcaaatccatccatacgcttgtcatttgtgcctaggcagaccacaacctctatgaggtcactacctattctcatccacctccacaggtgtctacgagtggccagggctccctaggtgaaggactgacagcctctgtgagctatagggccaagccccaggtcctccccaacccccttgcctcacacacagtctgggtcatggaacctccaagctggatgacagttctgaacagggcagcacccacattaccgtaagtcccaggcctctgtgtcttcagctccttccttagcactgggccctgcagagtgggggtgaaccgggccactgcagaggcctcacgactccagctcttcaaaccagggccgagcacagagcctccaacaccagagaacttgtgacacctccaccactggtggggagtctggccagcccaggccacatgcctcattctgacacacagccacaccccactcccacaagccaggctagtctgcaaagccaggggccaggccaggctggaggctgatctctgcctccctcaacacaggggcttcactctgcctgaaactagcctctgagtcacctgcagctgggcccagccagccccttgctttgccaggcgcagacacgcactccgggcaggggaagggaatgaacgagcacagccagtacttggtaggtgtggagggcctggaggttgggctgccgggggctgtggtgggcactggagacacagagtcggtagtgcagcacctccagctgagagagtgaacagagagaagccggaagaggcagaagagaaaagcatgagaggacagggtggtgaaggagagacatggtaccggacatgggagggggaagtggagaaagaaagcaatgagaacgagcccagaagtgaggagaaaaaaacaacaaaagcatggtcagtgaccatccaaacaactgcagtcccagcagctgtgaccagcgcagcaccctcctcggcagccaggccagagctgtgacagcactctcctcagccttggaggctgggggcggatagaccctccaggtcacctgggtggcctctcaatgtcgctggggcctaaaggcctctccagctcattggaagggcccaactcactgcccttccagatgggacccgctctccccagtgactctgaggccacaccgtgtgtgccatgtgcacaccacagcccttcaagtacccagggccttctctctgggacatgctgtcagccaccaaggcctcaagatcctgaggcccagaaaataaactggcaaagcatgttctaggaggaggactctgcctagagaagacacatatgtaattgactggatttccctgggttgttttgagaaatttatcaaatttgtatatgacatgatcaattcctatgtctaaaacccaatcaatgtcccctccatgagtggatctctctgagagctgaggatgaggacaggtccccaagggtagcacaggctcaggcccccaggccctgccctccgcactcccccagcctggaggtcagccgaggtggtgtgtgcatcagctctgactccaggaggcaacctctcctaccgcatcaggaactcccaccctccagatatggagggctcccaagggcaggagcccccgaggacctggccacagccacacacacccagaggcaacaggaaactgaggctaagctggcccccagccaggaccctccaatctaccaccctgcagcgctgcagcctccgaagcaccccttcggcccagcatagccagagctggcctggtgcatatcctgccccgtgagcgccatgcctcctgcccaagtagcacgaccactgggctccacacaggagacatcagaacacacctgctagatgtcacaacacgcagagcagggcgggaaggagcagggcagagagatgttgcccttcacagccttcctctgtgccagacctagggctcaggcaggaaacagacacacagttctccagtgcgtctctgcccttgcctaaggaacacggtggcttgtggggccattggccatctttatggcccacggggccaccagggagcaagcatgcacctcggattcaaccagggtgtggagggcaaccctgggagcctcacttcctgcatctgaaaataagagctagcagagacaggcagggatttctgtatggcaggagcagcataggcctgggcaagcggcaaagggccaggggccttgggggccccgacctccacagctgcctttctctgacccccacccacccagttttctcacgttttgttttttgcctcaactggaagaggcaaaaagtggagcatctctgggcacttcgtcccaccactgcaagtcattctgagcaggactcacgcaacccaaggtctggccaagaggaagcgaacattgagaagaggggaaaggcacctcctgccctctgcagggacgacgccttgccagttcccctgacccatgaggacacagaatcctcacaggtgacagcccagaagagcctttctggcttgcccttgaaagtaggtgtgtttccactcactcagtaggcagaaccagcagataggaaggtgacacagtgcagcggcccctgcccctgccaggtcaagccacatgcaagagcgctgagcaagtgttctagggcgccagggagaagcggggccctaggaaccaaccagccccccaggcaccagccaggcatatgcagtaagtctgctctggaagcgggaagggcactgcaggctctttgtgactcaggaggcccaagatggggtccccaacttttccttgtgctccttccaggtgatgctgagggtgaggatttgggggaacctatgctctgagagagccttcacatggcaaagcatggggccacagaactggctgcagaggctgtggcagaaacagacccacagctcttctccagaaccggaggaaaagtgacaggaggctcttctgaagtttaactccatcacccacagatccttcattctggatgaagccttctggaactttgtcagcaataaaggcaaagtctcccatgcatagacgccacgggcaccggactacaggatgtgtgcccagggcatgctgcctagagagagagtggggagaggcgaggcggagggggaggaagcaggccaggctgcttgtaggagggcgccaggccccacacaccatgagtatggcggcttgctcatgctctggaggaggtgggggagtggggggcagacaaaggaggctaactatggtgccactatggtgggcatgggtctgccctgggccatcacttcatgggaaagcacaaaggcactgctgatggtggaggagacagacgagaacgcggctcccagaggcattgcagctcccccacccccacagcaaaagtgccacaacctcatctgttcctgttgccagggagggggctccggaagctgcacaggaaaggccctggagaggccagacctccaggcctcagtgtccacatatcagggtgcaatgccacctgctcctcatcgggaactagagaactatgcccacttcttattcagcttctgaatgaagggtgggtggtggatttctgcttcccaccatccggtctgtgaaaactcactcaaatgcaggataagaagcagcaggctgagcatggtcagaagcaggaggtgggaagaaaaactatggaaacctaccttggcatgaggggaactgcattttttggtacatctccagagaatagtgttgaagccacatttcgacaaaaacctgcaaaagagcattacgtagtcaaatcattctcgataactgccaagaccattcagtggggaaaggacagtgtctcccataagcagagctgggaacacagaacaccctcatgcagaacagtgaagctgggccctgccctcacaccatcgacaaaaactaactcaaagtgggtaagcggcctgaggataagaactaagaccataaacttacagaagaaaacatgggagaaagcttcataacactggatttggcaatgatttattagatatgatgcccaaatcacaagcaacaagcaaaaaaatacagcatcaaaagatactactgatagagtgaaaagaaccagcgggcatgatggctcaggcctgtcatcccagtgctttgggaggccgaggcaggtggatggcttgaggccgggagttcaagaccagcctgggcaacatagcaaaaagttgtctccacaaaaagcacaaaaatttgctgggtgtggtggggcacagccatagtcccagctactgggagtctgaggtgggaggatcgcctgagcccaggaatttgagctgtagtgagccaagatcatgccactgcactccagcctgggaaacagagcgagaccctgtctcaaaataaataaataaataaataataaaataaaaatagaagcaactccagtgttcactgagagatgaatagataaacacaacatggtacatccgcacaagggaacactatgcagccttaaaaaggaagcaaattctgacacatgctgtaacatggattaatctcgaatccattatgctaagtgaagcatgccagtcacacacaaagaagtactgtgtgctacagaaaaatgctttagatatgagatctaggagtcaaacatatagaaacagaaagcagaatagtggttgctaggggctgcgtggggaattaattgttcagtttctttttttttattaaaagagatggggagccaggcatggtggctcatgcctgtaatcccagcactttgggaggccgaggcgggtgcatcatgaagtcagaaattcaagaccagcctggccaagatggtgaaaccccgtctttactaaaaatataaaaattagctaggcaccgtggcaggtgcctgtaatcccagctactcaagaggctgaggcaggagaatcacttgaacccgggaggcagggattgcagtgagctgagatcgcaccactgcactccagcctaagcgacagagtgagactctgtctcaaaaaaaaaaaaaaaaaaaaaaaaaaaagagagagagagacggggtgtcactatgttggcgaggctggtctcaaactcctggcctcaagcaatctttcccaccttggtctcccaaagtgctaggattacaggagtgagctctcatgcctggtcggttcagtttcagttttgcaagattctggagattggaaaggaagcaaattctgacacatgctgtaacacggattaatcttgaatccattatgctaactgaagcatgccagtcacacacaaagaagtactgtgtgctacagataacaacaacgtgaatgtatttaatactactggctgtacacttggaaatggttaagacagtaaattttatgttatgtatattttacaattacagtttttttcttaattaaaaaaacgaaaagcattaatgctttggtccaggaaacagcagaaccttccagttctgtcctgttgtaagcttgtgtcatggtctcctgccctcttcacagccagcacatcccatggtccacacagccaagagccatctgggtatcatggtcccctctggggaccatgcccctcccagggacaatggtccctatcattctagcacccgaggttgttgtgaaatggtgtggaggcttcaaaaagcacggcaccccacatattaggagttatgtacaaggtcggagacagaatcctatcttatctacttcccaggtgtcaacggcgaggctgtggctaccaagtcagtcctaggatccagtgtcaggagcagcacctgccaaatctctccaagttatgctcagaagacacagccaggacctggtggatagcactcagggagtgagccagtccacaccatcgtgagaggctggagccccccaggacagacaagggactctgtcacctactatttggatcccctgaatcaacagaaggcctgtggaggctgcacaaacccctcaccattccgtgtcacaaaagtgctactggggcaacgcttaatatccacatgatggtaatcataggaagcatctccagcaacacgagagacggacaccaagagaccgcaacaattatatcacaatgggcaaatgaaacgactccgatggacaggggatcctgggatgaaaaacaccatgaatgacaagtaagttaggtgggtgggcagacttatattcatgttttctaaatgtcataccaggaaaatgccaacaatttagaatcagccctgggctaagcggccgcctctgggactctgacccatatagtggaagatggctgaccagtttcttttgaaacagacgttgagaccagctcagctctcacccggagcagagtttctgacctccagatctcctgggaggcggggtctgcattcacagacatctgatgagagaagtgtcgcttcagggggctagtgtgctggaggctacaggaagcaaagggcatggctggtgtcctgagggagacacggaaacaggcccaaggtaggagctcctgctggccaggccaggggcgatctggacatcaaaatcaatgacagcagggacgtattacaacttgttcaattgcacaatgcacaaacctcacccctgccccaaatccacactgatacacctgaataaacaaatagcaaagagaaaagtcttccttcccgcagagcgaccactgacccaatacaggaagaatgaagttagggaaccaccacttggcaactgccctattaatagcttatttggtcaagaatcaagtgaggccaggcatgggacctgcgtgagacgcctgaaatctcagcactttgggaaaccaaggcaggaggatctcttgaggccaggcacttgagaccagcctgggcaacacagtgagaccccgtctctacaaaaacattaaaacatgaaatagctgggcacggtggggtgtgcctgtagtcctaactacttagaaggctgagaagggaaaatggctccctccttgggcctaggagttgaggctgcagtgacctatgatggcaccaactgcactccagcctggggtgacagagcgagactctgtttctaaaaaaaataagatgtccagcttgggcaacatgggcaaaacccatctctattaaaaaaaaaaaaaagcattcagatgtggtgatgcatgcctgtagtcccagatacttgggaggctgaggcaggaggatcacttgagcctaagagattgaggctgccgtgagcctagatcatgccactgtacttcagcctggggtgagagaacaagatcctgtcttaaagtaaaataaaatcaatttgaaaaaaggaaagaatcgacttctctgtgtatggagtagcccttcttctattcctttactttcttaataaacttgctttcacttaaaaaaaaagagaaaagaatcaacagttgatgttaatactagtgataatacatagtctctatacatcttcccggtaaatcatcattaccaatttttcttttttttgagacagggtctcattctgttgcctgggctggagtgcagtgctgtgatcacagctcactgcaacctcaacctcctagacccgggcctcccaagtagctgggaccacagtgcacaccaccatgcctgcatgcctggctaatgtttttctttctttgttttttgtttttgttttttttttgagacagactctcactctgttaccaggctggagtgcagtggctccatctcggcttactgcaatctctgcctcccaagttcaagcgattctcctgcctcagcctcgttagtagctgggactacaggcatgcaccaccacgcctggctaattttttgtatttttagtagagacggggtgtcaccatgtttctcagcctggtcttgaactcctgacctcatgatctgcccgcctctgcctcctaaagtgctgggattacaggcgtgcaccaccacacccagctaatttttgtatttttagtagagatggggtttcaccgtgttgaccaggatggtctcgatctcctgacatcgtgatatgcctgccttggcctcccaaagtgctgggattacaggcatgagccattgtgcctggccaatatttttctttttagtacaaacaaggtcttgctatgttgtccaggcactcattactaatttttttttttttgagatgggctctcactctgtagcccaggctggagtgcaacagcatgatcttggctcaatgcaacctctgcctcctgggcttgagtgatccccccacctcagcctctaagtagctgggattacaggcgcatgccaccacgccaggctaattttaaaatttttggtagagataggattttgctatgttgcccaggctggtctcaaactcctgagctcaggtgatccacccaccttggcctccctaagtgctgggattccaggcgtgaaccactgcactcagcctcattactatttaatctgggcacgaagtacttattttacagtggacaaacctggccgacaccctttccacccagtgataaagctagcatcaccagtgatggggcaaaggggcactgcaggcctcctgatgagacacctggcaaggaccaggtgtccccgctgcagtgctcctgccaacaaagcccaagctatgcctaatcaccagcaaatacaagacagcccaaggggtggccacatgctttggaggggtcaaggtcaggaaagacagacaggctgcagaaccattccggactgaaggggactagaaacatcactgcatgcagtgggtgagcctgtgctgaaacccagccaggtaacgggcatgagtggggtagctggtggtgaaccccgaggtctgatgactaggtgtagcctggtggcaatactaacttcctggtgtggtggcatgtgctggcttgcacatgccagcagatctggggtgggccagcatctgcagaaacgggcctgtatgcagcctcctggggaaggcaatggggcagcaagattaaggagggtcagaggagcacacgcactgtgactatataagataatgcattcacttttaggaaatacactgacatattaagaggccaaggggtgtcctacctgtagtttattcttattggcttaggggagaaaaaacatatcatagaaaggggataaagcagatgcagcaaagtgttaatttggaaatctggatgaagggtctatgaactttttttttttttctgaaacagggtcttcttgtgtcaccccaggctagagtgcagtggcgcaatcatagctaactatagccttgaagagtgcacaagagatcctcccacctcagtctcctgagtagcttggtccacagttgcacgtcaccatactcagctgattttattttttgtagaaatgaggtctccctatgttgcccacactggtctcaaattcctggcctcaagtgatctttctgccttggcctccctaagtgttgggattacaggagtaagccaccatgcccagtctgcaagttctttttattatgcgtggaaacttttctgtaagtctgaagttatttcaaaataaaaagttagctaggtgtggtggcctgcgcctgtaatcccagctacttgggaagctgaggcaggttcaccctcccaatccgtgcagtatggcatcaggctcagcctgtttggtctggcacaacaggctctttggcccagggcctccccctctcaagacctgctcctggggccaataaaggattgtggaagctaggagttcaagacccaccagggcaacacagcaagcctcccctgtcatatctctacaaaaaaaaaatgttttaaaattatctggctgtggtgatgcgtgcctgtagtcactgaggtgagaggatgacttgagcccaggaatttaaggctgcagtgagtgacgactgtgccgctgcactccagcctgtgtgacagagtaagaccctgtctttaaaaagacataatgactgaatgtggtggctcatgcctgcaatccctgcaccttgggaggctgaggcaggaggatcatttgagcccaggagttctagaccagcctgggcaacatagcgagacccatcttacaaaaaatacaagctggatgtggtgttgcacacctgtaatcccagctactcaggagactgagacaggaacatcacttgaacctgggaggtggaggttgcagtgagctgtgatcacaatactgccctccagcctgggcaattgagcaagactctgtttccaatatatatatgtgtgtgtatatatacacatatatatattatacacacacatatatataacataaatgtgtatatatacacacattatatatatataatttctaaaagaaaaaattaaattacaaaaaaactcaaaagctgggcataaaaaccacttggcaactgaattgtacatctgagagggtgtgaatccacctcacctccaagtcctccacagcatcagcaacatttcagggtcactgaccactgccgccacccaggcagcctctcctccttgctgctccctttctcccctccaccctctggggcatctgtccacacatgtgaattgtaggtagaggcctgtcctggcttgcacatgccagcagatctggggtgggccagcatctgcaggaaggggcctgcacgcagcctcccagggaaggcgatggggcagcaagattaaggagggtcagaggagcacaggcagctgctgcctgtgcagagggtctcctgggaggtccccagagggtctcctgggaagtcagccaagaggccctgggttagggcccactgagaccccagcacagctaggcacaagagcccctggttcacacttcccacctgtgcagtcaccaacaggctcagcttgtttggactgacacacaggctctttggcccagggcctccccttcaagacctggtcctggggcccagagagatttccatttttttttcccccatagaacaagccttctgccatgctcaccacctcagacactgcatgtggggagggctgcttcatgcagaacacagcccattcccatgcaggccgtggaggcctccagagacctgatagcttcagtgatggccacagacatcgaaaactaaaggacagatcaccctcctcacccccaccctccagtctgtgctaagaaagctggaggtggggaatgaggcataagacaaatttgggaaccctggacaaagggtggcaccattgtcctggtgggtgattcaactgaccaggccactcccttatggaagggccaggtcttcacaatcagggtagccttacctgggagcaggtgagggactggcccatcctgggctggaggacagtgagggtggtggcaggctgcctttggtgggcaggaaccatgacaggtacctgtccaccaggaggaaataggtacagtctgaaatatggacatggagagacacagggagtggctggaaaaccaagctagttcttagcatggggtctgggcactgcctggccccagagcactggcaagtgcagggaagccccgggccatgcccccacccctcccagcaagaggcatcccttccctacctttagtgtgttgaggctcaaggcaaagaagcatatgtaatactcgaacggatctgatggcagcgtcaagggcaaatacacagggttgctgggaaacccccagtgttgagagctgagccacccacaaccttcctacctcaaggccaccaaaggatactcaaggccaggttcaggccaaggcccttagttgggcggaactggatcttgtgttacagaggactgtcaaggacgcactcctggatggatgccttcacgagaccctgcagagagaggcagcaaggcttgtgggcaggcactggcgtgtagtgcccggtacgcagtgccccacatgcacagcagccctttgggaaagctgctggggaagagacccgcacacagaactcacctgtggggacagtgccctgctcctgagcagtgcctcaacaagagtctttgctcagaacttccaccatctcataaaaagctgcagacaggccaggtatggtggctcacgcctgtaatcccagcactttgggaggccgaggtgggcagatcacaaggtcaggagttccagaccaacttggccaatatagtgaaaccccatctctactaaaaaaaaaatacaaaaattagccgggcatggtggcatgcatctgtagtcccagttacttgggaggctgaggctgaagaattgcttgaacccaggaggcggaggttgtggtgagccgagatcgtgccactgcactccagcctggcaacagagtgagactttgcctaaaaaaaaaaaaaagctgcagatggcaagggtagcagccatgcaatacccatctcctttgcctctcatacccccggagcaaatcactccttaatttgccctcagaggaccggaggagactgcccgtcaccactgggctgtgcaaggtccactgcccgagcaccactctcaccactgtggtttacttatgggcaggtaggagatgggaaagtcaaacttaagtcttcagcttgaagcttataaaccaacttcatcattgggccgctgaacatgaaattgaacaaacaaaaacagggtatatgaactgcaaattatcttgctttgattgtatcttaaccttaagaaattgagagtgacttaaaagtggaatcaccatgaggaagcaccctgcctctctcgggtgtcaaacctaccttcccagggtcgagaaattccatcaccatgctgtacttcacaggattcacgcgcctctgtaagcagcgcaggttccagcccacaaggacaccatccaggctgccgaaaatgctaccagccatggggagatggcgtgcagctcctgaaacagtgtgcggtgaggctgcaggcaggaccagcacccactcctgccccagctccaggcctgcaccacctgctgcccagctccctctgaggaggccactccctggctgagacccatgggatcagccctgcgctcaaaggaaccctggtgcggtgatgccaatgagaagagcagctttgggttctttcactggggtacgtggcttaccaagcagtgctgctttagacgtgggccagttaagtaagtcagcctctgatcaaaatacattttttgtgtgtgataaaagcctaaattaagggaaaaaaaaaacaaaaaaatgaaaaaatgaaaaataaaataaaataaacaaaatacctattcttttgagacagggtctcattctgttgccctgtctggagtacactggcgcaatgcacagctcactgcagccttggcctcctggcctcaagcaatcctcctgccttagcctcctgagtagctgggactgtgggcacacaccaccacgctcagctaatttttagatttcttgtagagatagggtcccagtatgttgcccagactggtctcaaactcctggccttaagtgatcctcccacctcagcctcccaaagtgttgagattacaggcatgagccaccacaccaaaagattttttttttaatgtcagaaacttctgatggatgcgaaggatgctctattagaaaggaaagcaacacccttcccagagtgaagcccttaaaatctaactgacctgttgtcatttggtattaactccttgtctaggccagcttcctgggcttgacaattccaggtgtgatttaaatacatatttttagcatttacatcagggttcctcaacgttgatgctattgacattttgggctggattcttctttgttgcagggagctgtcctgtgctttgcaggatgtttccagcatccctggcccctacttactagatgccagtagcacacactccccatcacccccagttgtgataatcaaaaatgtctctgatattgccaagtgtcccctgagggacagagcacctgtggttaagaactcctgatctgcaagttcacatatttaaatgtgtccataaacatgacggtcatgataatgggccaggactctgtgccaggcagtgcttggagtgggggtggtggggggaattaggaattataataaagtttttaaaggaatgtgtaagacatgctccaaagagagatgtcagcagagctatacctctgctggaaaatcctcaatgactttaaccaagtcttggcatcactgtgcaaagggcttatttacagagtcagctttcagggtagcctagaaggtagaacaaagtgaaaaaatcatgaggacattcactgcagcttttagtgatactctggcttgagtcaaacagaaatccaagtgataggttatgagtcagacacataaccactggcgtgattccccagcccctcatgtgtgtcagtggcccaaaggatgctactaggagaggctgtggttctatgcactctggaccaggaactctcaggcttgcttcccagtaccaactcagcgtgctgctcatcatcagaacaggactgacttccaccaatccataagtaggggttggccccagggtcagccccagagccagaagaggatctcgattgtgtaagggcacctctcacagaccacagagtactactgagttcgtacgcatcaaatggaaatttcccacctgatggaccatcatgattacacagttgtgatcatcagtaagaatgcccaacaaaatcagggctacagcatcctctcttaactgagctgtcttttattcagcagacagtgaacctactaaaccaatgaccttaaaacacagggcagggccgggcgtggtggctcacgcctgtaatcccagcactttgggaggccaaagtgggcaaatcacaaggtcaggagttcaagactagcctggccaaaatggtgaaaccttgtctctattaaaaaaacacaaaaaaattagccgggcttggtggtgcatgcctgtaattccagctactctggaggctgaggcaggagaatcgcttgaacctgagaggcagaggttgcagtgaactgagatcgcaccactgcactccagcctgggcgacagagagaaactccgtctcaaaaaaaaaaaaaataaaacaaagcaaaacaacaacaacaaaacacacacacacacacacaaggcaggtaaaaattatagatggcttgcaccaagtaaacactaaacataaaggcaatggagaggccagaaaagactcaggacaaggactaataaaatctacccacagtcgtgggatatacggaaagcatcctgactacaaggataaaaatagcgtctgtgcaaatggactcacatcaggagaaactgctagaatctgtctacctccaaatgccttgtctacctccaaatgagggtggatttcacaggatttgagacaagagatggagacctgagttgtctggccatgtggcagacctggtggctctagtggggtgccctggggaggaacgtccttccacatacatatttacaaaaatacctcctaagaactaaaattaggaactttcatcaccaatacttgctcatacctaacttctcgcttctcagtatcattttttcttttttttttttttgagtcttactgtgttgctcaggctggtcttaaaactcctgggctcaagtaatcctccttcctcggtgtccttagtagttagaactacagatacggaccattacacccagttctcagcaccatgtttaatagttaaagtgctaacctagcaccccctcagaacataagagtgtctccatttttcactaatgacaattatgattatcagaatgtttcatgtctgtttaagaacttacagatcatgaacactctgatgtacatcattctcatttgctcctccccctcctcctcctcatacccccttgggaagtagagaaaatagaacttgaatgaatttgtcttgtatgggaaaacccagagcccagagcccagcggttgagtaaccccaaggccctgtagtaataagggggcacagtcaagcttaaggagtctggcattgcttccatcacacgctcctaaaagacaaccactagagaattcttcaagtcaatgggaagaacattcaagtcccacagctacagagctgtggccacactgacactcatccagacagctgatatttaccagtagaaagctgggccgctgcaggtgagggaacgccataaaagcctccagtggagagttgaaaatggccttcttagcaaaccactgtggaaaaacagagacaaaatctcaacatctgcagcacagcagaatctttttatttttctagagacagggtctcattctgttgcccaggagagaatgcaatagcacgatcatagctcactgcaacctcaaactcctgggttcaagcaatccttccccctgagcctcctgagtagctggaactacaggcacacaccaccatgcctggctaattttcttcttattttcttttttgtagagacagggtctcgctatgttgcccaggctagtttcaaattcctggcctccactggccctcctgccttggcctcttaagtgctgggattacaggtgtaaaccactgcacctggccctaacaaaatattacatagtttcacaatgcccaggagaacatttgtgtaactcaacatgcattacattatcgattctcatgtcttctttatttatttgtagagacagggtcttgctttcccactcaggctggagtgcagtggtatgatcatagctcactgcaacctcagactcctaagctcaagcgatcctcctgcttcagcctcccaaatagctgggactacaggcacacaccaccaggccctgctaatttttatatttgttgtagagatgtggttacatcatgttgcccaggctggtcttcagctccagggctcaagtgatctacttgcctcagcctcccaaagtactgggattacaggcgtgagccaccacgcccggccagcaattcccacattttacagaaacaccattcgcatgcagcccacagtggccagcttcagagccaagtctgtggtactgaatccttggtaatgcttgtacagcacttgctgtatgccaggacttgctctatacaccacacacactgtcagtccccaggaggggaatgtggtatgtgatgcttcataaacacattgaactctttctgccaaggaacagccattaacaccttggggttacttgcaactcacctgtggactgttggtctgagctattgtccatcacttgcaactcagtgtacacaggttcatcagagctggtcccaaaagcaagtccaagcgctggagagcatgagtgggaaatctcacttccacctcggatggagaaaaacttcagcaagattgtcattttatctttccgacccagatggactccatcttgactcaaagacaaccagaacatcaccaagcatctcctacagggcaggcttggtactaggtggttttatttagattatttcatggaatgttcaggagaattgctccctcttcactcctgaattcttgatgcagttcttccactttcgccctttcttctcgtctctgtctcattcagctccctcattacaaaccttccaactggctggatggcgcagttgctcaaccagcagagagcactggggtagccccaaataaatgttcatgtcatctccaaattaccagcactattcccaggtcccaattcaagacaaaaccttatcagcctcatcagtgagagcacgttttcaccgagctgagtaaaaacttaggtacaagaccattcagtggggaaaacactcatttctttgaagaatggtgctgggagaactggatatccacatgcaaaaggatgaagctggacccctacatcacaccatatacaaaaattaagtcacaataggtcaaagccctaagtataaacactaaaactgttaaactctaaacaaaaaacatggaattacattttcaagatcttggatttggcaatggattcattcttatttggtttttaacttcattgtgagccaatttagcatccaaaattccagtaggtttggtaaaaattgacaagctgattctaaaattatagcaaaaatgtaaagggcaggccgggtgcagtggctcacacctgtaatcccagcactttgggaggctgaagcaggtggatcacttgaggtcagtagtttgagaccagcctggctaacatggtgaaaccccatctctgctaaaaaaaaaaagaaaacaccaaaaattatccgggcatggtggagtgtgctgtacctgtaatctcaactacttgggagactcaggcaggagaatcacttgaagccgggaggcggaagttgcagtgggccaagatcatgatactgcactccagcctgggtgatagagtgactctgtcgaaagaaagaaagaaggaaagaaaaaaaagaaaaagaagaaagagagagagagagagagacagacagacagacagaaagaaagaaagaaagaaagaaagaaaagaaagaaagagaaagagaaagagagaaagaaagagagagggagggagggaggaaggaaggagaaaaaaatgtaaaggacaaagaaaatctagactcttcttaaaggacaactcacctcatcctggtcatcttggcgtcttcatgattatgagcatgaggacttctagaattctctctctctgtcccctgtcctctctaggattccacagtcttcccaggtgaccaatacttgggatccacctttcaggcaaggtcctcttcttacccatggggcttacatatctaatccagtggttcttacccagagctgtgcactggcaccaggacaccccaggcacacttggggcagcccctagagattcggttggtctagtttggagtcttcttccacaaacgcgactgtgattgatttacatctgtgactgaatccctagtgaagatgcctaattgcagcacagtgacctcagtgacgctagccctaagcatagccacccagaagaacagggcatttggccaagcgagagtggtgttctgaggagggtcctggtcacacacctccatctgtctccacacctgtctggccatctgggcccagctaatcggagtccagtacctcttttcttggtctcaggcccacacagcttcactcttcgcatgtaagccatgcccctctgaatttctgatgccactatcttatctccagtgctggagttactacttctttcagggaacatcacaattctttccgcatttgaaacttcccactttcaaaagttttgtctttctcagtgtcacctcctctgtctaagggtagggcccaggtgtgagaagcagggaactaagagaaccatcctgactctcggggagctgttctgccttggcccgttgctgtgaggacacacgtccatggtactgagacagccaacagccctgggaaccagaaacctcaccctcctatgagcaggtcatggcaggtagacacaagccttgttctgggggccaggctaagaatgtcccatggattgaacagtagagacattgaccctgtttgaggtgtgaattctagatttgagctccagcagtgcagttagaagcagccgacctgcctctagttcctaagccctcgtacccatcacactgttctacagaagtggccacttgatcccctaaagctgtgccctcaatggacactttgttcacatttaagtgaatatgatccttttaaaaattaaaaatacatattttaaagatagtcttaccctgtcacccaagacggagtgaagtgggatgaacacaggtcactgcagcctcaattcctgaagttgaggagtcaactgcctctgtctccaaagtagctgagactacaggcgtacaccacacctggtttcattcaggtgaatataatctttgctgccagcatctcaccctttgatagtaatcacatcctcttaagagggctttggaaacaattggccttggctagccaatcccaggttttcgcttccatgagggtctccagcttcacacaatattgtgcccatatctgtagcggccttggtttttaattgcaaacaacagcatccacccacatcagtgttggtaaaaaataaattgcttttttttttttttttgagacagactctcgctgtcgcccaggctggagtgcagtggtgtgatctcggctcactgcaagctctgcctcccaggttcacgacattctcctgcctcagcctcccaagtagctgggactacaggtgcccaccaccatgcccggctaattttttgtatttttagtagagacggggcttcaccgtgttagccaggatggtctcgatctcctgaccttgtgatccacccgcctcagcctcccaaagtgctgggattacaggtgtgagccaccacgcccggccaaggtattgcttctttaagaatggagctgttaatactgctggtaccagaaacattaaaaaagaaaaatcctgcatgagggccagaggaggagtacaggagagtgagatggagtggaatcctccagtgggtgatagatggatggacagacagatgaatagacagacgaacagatgaacagacggacagacatgaataaacaggtggacagacagatgaatagatgaacagacagatggacaactggatagatggacagatgaaactaataatctgagaaatcagaaaagcttcatgaaaaaagtgggactgagctgtgtctccacggatagatataaaagcagaggactctccacttgagtcgagaatgacccagtgtcctgatccagagaggaagccagcctggcttgactgggaaatttgtgggaggactcagaggcccttaaaatgaggccaggtgaggttgggctgatccgagccagctcaggactcctctgccacacagcacagctgccttaggggacacattactcagggagttgctgggacctactgggcccagcattgccaccagcaccaacagcttcagagaggggggacacacacttggggtgactccaagactgtgggtggcacctgcctcaaacaggggacaggcacagggacacctctcggggtctggcacccccacgcactgtgcctaggtcccaacaacgcccactgcagccctgtgcccatcatgcccagaaggtttccgcttcagcctggcccctgtactggccccaggaatttggacccaagcctcagtcactgggtaaacagcagtgggaaccagctcattactctaggtaagtggctcttacaaccttccccagccagttccaccctctgttgtctctggaaaatatgttttctctccctggggtggcttctcctctgccctcccagccttaatcactgacccctacctttctctatgggtcctgggggaggtgggttagtcttgaggtaaccagcagaagggccccaggttccaacagccagacgcagcctggtcccggggcctgggctgggtttaggcaaggtcagagttccttcacctctttcagggcaggcacccgaggtgcggggcaaaggccagttctgactggcacactgcagtagcatcagagacaccccccggaccccagggtctaggctgatggctggatgcccatccagcctgggaaggccacacgggggcctggggacaaaggggtcaccatgaggtgacatcaatgcaggtgcagagagggctctgggtctaggctgcagctctctggcctctgctgggtcatgaggacacagggacaaaaaaagaagatgggtcagatggggcaagatggccagagcccagccctcccagaatagtcatcagagaggagcagatcccttagggcagagacatatttgtccctggagccccttcacccctggggcctggcgtctcactgtccatgggtcagtctcccaccttcctcaaagggcacgttagactcaggaggtgacaagaggggagcgaatggggggtgcagaggactctacggcagccagctgaagtctagagttgtcagagtccgtggaggcaggcatggggggctgctgtgtcccgtggtccaggggagcagccccaacaccacagtggaggtgaagggtcctatggttggggtggtggggacaagggaggtgaagagcggtggaggagccccggggcttgtctgggtgcagcccacccttcatcaggaaagctgaatgggatgggctggggcaaagcctggtgccccaggggacaggaagctccaggccccaccaggcttgggcctttccacactctgccaggatagtcctgtgggctgggcggggacgtgcaaattccaaactcagactccagagaccagagaggagggagcacagcctgccctgggtacacacagggaaacagaggctgcagaggagggctgggccagggctcctagaaaaggtgacttgggaagagctcctaggaaggtgcgggctggctgctctgcagaggtcttgagtgaaaaggaggggaatgaggagggaagaggcagccccgggtggactggacagccatgccgtgaacctcacagagactttagacagagagggggctctacaacaccccagtactccctctgcctctcttgccccctcctctgtccacacaggtctgcccaaggccgcccctttggacactctgaggaactccaagccaacaagatgcctctcattagtgacttctaccctgatgccgtgatggtggcctggaaggcagagggcaccaccatcaccctgggcatgaagactgccacaccctccaaacagagaaacacaagtacacggttagcagctacctgaacctgacgtctgaccagtggaggtcccccagcagctatgttcttaggcccctcaccccacccacagcagccaggagctgcaggatcccagggcaggggtctcccctcccaccccaaggcatccagcccttctccttgcacccaataaaccctcagtaaatatcctcattgttaatcagaaattctgctccctgtcttcatttcttacctttcatataatttgacacttcccccaggttctcagtgggggatgggggaatcctgacactcagtgggaaaatagcttgtgggagaggctcccaggctcccaggggcatctgctggagaaacaggccaggcaaggagcaatctgatcactgaagaccagtccctctgccctctccctcctccaattccccgctgcagcactccctcccccaaccccccgccactccctgcctcctttctggatggagctgtccctggctgggccttcagatatgccctctgtccttgccctagtaaagacactcttcccacctacgacctctttttcctcagcctggaagtaacactctgggcctggagttcctctgcccgtggccctggcccctggaatcccctcctccctctctgcccaactccccacccctgagagctggactgtccagaatactccagcaccttcaaattcatgagctgttaaatttggggcccacctcgattcttcacctgccagcaggttcacaggtgtaagaaaaatcggaggaaggcaagaaggaaacacacacaaaaggcttgcaggaggctcaggacacttgccaaagataggctctaagctccccaggaaccagagcaagaagggtaacaggagctccatcatttctatgagatttaacaaagcctttgcttgagggaagttggtgttttcaatgctgaggccaggcatctcctcagaactaacagtggggatgtgttttttgtctgtttgttttgtttcgttttgttttgagacggagtctcactctgtcgcccaggctggagtgcactggtgcaatctcggctcactgcaagctccgcctcccaggttcacgccattctcctgcctcagcctcccgagtagctgggaccacaggcgcccaccaccatgtccggctaattttttgtatttttttttagtagaggtggggtttcaccgtgttagccaggatggtcttgatctcttgacctcgtgatctgcccaccttggcctcccaaagtgctgggattacaggtgtgaaccaccactccaggcagtggggatgtgttttacccaatcccttagtattgattggatttgggctccgacacctgcacaggtgactgcctggcagccccagaacacggagatgttctcaagtgtgtggcacagaaagtcactggctgcctttggggggcattctttttgggaaacacctctccattggatcctgggcctcaggtggaaaaccaggtcctgcctcgggactttctctgtgaggctccctgggtctggggctccagccattctccgagaggaaggtgccaggagagagagcaaggcccagccccacctagtctttcctgcatggtccctgctctggtagagacagggtttggcctggctgggttccacacctgctgaaggatgcacagatggtagatgcccagtctgaccctgggtctacccagggctaacccccttccctgaggccagactgaggaggctgagcctgcccaggtcctgcaggtgttcagggcagcacagacagtgggtgcccaggcccctgacccaaggtcacccttccctcttgaggctgtgctaggcagggccaggagacagtactgaacacaccaatccccttgtggctctgtggggttggggacctacactcctcagtctacatcgagccggtgtaggagacaggcagaagcaggagggtcctcggagtccacaaagcagagcaggggcaggtgctcgtgtgcccatttcaccgaagagagaactgaggctccacgggaagggaagtgacctgcccgggtcaacatggtgagctgctgcctgacccacccccagcctctttccacagctcctcagtccttcattcattcactcacacactcattcagcaaaccctcagtgagcacagctgtgggccaggtgctggtgcaagaccaggaccacctgccctggagaagctcatgagctggaggacaacagggagacaccactgcacccccctgtcctcaagtccccaaggttggagcttggcccagggagcgcctggggcagcaggggcatctccccctacttagcagaagatttaactgaaagaaccatctgacggagccccagctgtcatccctgggccacagtgggaacatcacagtccctcatcaaccctcacagtgaccctgaggcccagggcagccatggtccacctcacatagggcaggccgaccatgaggaatgcaccacggttgcctcatagcgaccctgagctctagagctgccattgcccaccttatagaggggatgctgaccaggagggaggcaccaaccagggccacccaggctccggccagcctgagagtggcccagctggccctgtgcctgcactgccctgcacctgctgccctgcccagctcagaccctggtcatatcctcaggagtgatggccccacagcaccagggcagggtaggtccacactgggagagcccctaaaggtacagagaagagcactggagtccagggaggagggattgtcccggccctggtcctgcctcgctgtgaccagggctgaggcatttgctctaaatcagatgggggaggggcatctgtggcttcctctacagccaaaaccagagccccaaatagccccggtgggtatggaggggccttgggggaggggaggaaatgggaggggaggtggctgcttggggctctgggtgagggctaggagctcctactgagctaagcggatgactctcctatctgacctggccccccatggggcctgcaaaagcaccaagagagcatccccagccaggcctgtggaggggcccttgacccctcatactcactgagcccagtggtgggaagagggggctggtccccggccagtattctcctgaggacaccgacactcactggtaacaagcaaaccagacccagatgctccaaaaagaggccactggatcccagcaagcacccactccccccaacacgaaggtccaaaaccaagcttcagccaactagaatgtgggaacttcccgggaggtagaggaaacaagtcactgtccacttgcaatgcccaccggttagtgacgcagcacaatgacagtcacacctctcagagggggctctccctcgactctccttcctgacacatcaacaaggacagccttaccaagggccacacctgggcagtcaccatggggttcgtggtctcacgtgggccctgcttaaagcccctggggataagctcactccagctcatgagaggccgggggtgaccctgaccccattttccgatcagcgatagcacagcacatgtggggaccaatgagaaatgagtctggggagaccacgggcttcagggagaatgtttcgatgaggcaagtacaagagccagtgagggactgggtgacttctgtggcctgtgtcacagagctggggccatcagatgccccatgtccactctgaggacagagtagcccatggttaggatgacccaccagccaggcctggccagggcacccacaggagacaggaaggctgtgagggcccgggggcacggagcagctctgaaaggaaggggtgctgggtcccggggctcctgggcagagtggttgaagaaggtgagaccccagaccagccagatgggcccacttctcaggggaccctggtcagacaagggagcacctcctgctcatggaacacagcaaggggcaaggtaggcacagccaggctcggagaactcgtatttgggggagatgtaaatcaacccaatagacaagggagcgatgtggtgtaggagatggggtttgtgctggggagaaataaggcagagagtggggagtagagagcacctgtctggggtctcaggaggagcgatgtcccaagactggaggcggccaggggctgaggagccctgactgggccaggcctgtggctggagctggaggctcgggttcagcctcagtttcccctctgtgaagctaggttcataataatggaaattgactttctgggtggctggagagacattcagatggaaaatggatattctattttgtctctgtccttggttgttgtcatctcaggctgttccagccccagttagcctcgggtcagccccctgcccatgttggtctccccatgagctcaggcacctcatccccagcacagctggcctggagaaaccaagattccctgaggcttaaaatagctggaaagccagcccagctgcaggtgcctccctgtaggataaaatgtaggagaagatcttcaagagctaggactaggcaaaattttcttagacttgacaccaaaaacatagtctacaaaaggaaaaattgctaagctaagtttcatcaaaatttaaaaatttgttctgcaaaacaccttgttaaaaagatgacaagttacagactaggagaaaatattttcaaacaacatatatgaacaaagcactgttatcttgagtatataaggaacttgcaaactccacacaaaaaatcaaacaatccaattagaagatgggcaaaagacacgagcagacatttcaccagagatgatacacaatggacaaataagcccatgaaaagatcttcaacttcactagccatttgggaaatgcaaattaaaaccacaatgaaatataatttacacacatcagagtggctaaaataaaaaatagtgacaagacaaaactctgctgaagatataagtgtgaatcactcatatattgctggtgggcatataaaataccacagccactgcaaaagtgtggcagtctcttttttctctttagagacagggtctccctatattgcccaggctggactcaaattcctgggctaaagtgatcctctcgcctcagcctccagagtagctgggactaaaggcacatgctactgttgatgtttggcagtttcttatacgactgaacatggaactaccgtatgacctagcaattacattctgactcatctatcccagagaaatgacaacctgtgctcatacaaacaaccgtacgtgaatgttcattacagctttaatagcaatagccaaaaatctagaaataactcagccatccatcagcaggtgaacagttaaactgtgctacatccatcttatggaatagcactcagccatccaaaggaatcaactcttgatacactcaaccagctcaaccctccccagaacgcacctgggtgggaaggtgcacagcagattgggccactagatttacccagtgtggaggaaacaggtacctcctcctagattttgttcttggcagagataaaccagtgcttctcagtcatttttgctttttactagccatgggaggtattttccagtaaaggcttctatgaccaaatgcatttgaaggaatgttccatatgctctcccacacgccttcaatttcctgagagtgacaagaataccagaatagccaaggttctaagatatccttcaggatacctgtttaacttaaacttccccaaactatttgattatgagactcttttcaagcataaacattttccttccaggaacatttgtattcttataagaaaatattagaaagcattccaggtgacttacctaatgggagaacctcaggcgccaagccagatgagataaaagtttcaaatagtgctgataaggttttcttggttcagctgcctccctccaactcagctgctgtcacacttctaggcagttttgactggactgtaaattccttctggctggggccatgtctcagcaccttgtgcaggagtgatacaaactaatgcttcataataaatacttactcactgactttctctttattcatcccaggtgagcatgttttccatccccttcaatctccacactcacgggcaaaagtgagttgtgggtcttggaactctcaagaagaggaggagatcttcaatttgcatatgcagaatccaaacaagtcatcttgagtccccacaagtaggtgggcttatttctcacataacaaaatcgcccctcctttgcagcctctacaccactgcagatcaagcccagctaaaccttgctgtgctatcctgaaggtattgctcccagatcccggctgtcagctcctgtccagcatcacagggcaagtccagagacatgatcatgtaattgaccagggatgacaagtgggtcctctcagtggacaggtgtctgcagtaggtaagccctgtcaggagaggaaagaaaagcatcatcatctaccacctgataccctttgccctgtcttatggagtccccaaagtgctgtcccacactcccatctttatttttttatttttctgagacggtctcgctgtcacccaggctggagtgcagtggcgtgatcatggctcacttcagcctaagcctcccgtgctcgagcaatcctcccatctcagcctcctgagtagctgggactacaggcatgtgccatcatgctcagctactttttaacccctccttttcttcacaaggaaggcaaggcttgatgtcacttgctggctgaatggcttaatagctctacaaccctagggaagtcttatcaccttgctcagccacagtcagggtgatgccatcctcctctgctggaagccaaaacatttaattgataggctggaggcagagaagggacaggaaagaaggtggccaatgactctgtggccttgctgtgcctttgtctgcctccaatccatacacagagaaagacactgtgagatgtggacaactttctttcaaatatcagctgaatacaggtattcatccaaaagaaaggaaatcagtacatcaaacagttatctgcatgcccatgtttactgcagcaccattaacgatagtacaaaatcaacctatgtgtggaggaatagtacagaatcaacctaagtgtccatcaatgaattgacagttaaaggaaatgtggtatatgtatgcaatggaatattactcagccatgaaaaaggatgaaatcctgtcacgtgcagtaacatgaatggaactgaaaatcattatgttaagtaaaaaaagtgaggcacagaaagacaaatatcacatgttctcagtcatacatggaagctaaaaaagtatttctcatgaatgcggagagtagactggtggttaccagtggctgggaagggaagagtaggaggggaatgaagagaagttggttaatggtacaaaaatccagttagatggaattaagttcttgtatattatagtaggaaaaatataattaacagtaatttattgtatatctcaaaatagctagaagaactgtaaagttcccaacatgaagaaaacataaatgtttgaggtgatggatgttccaatcacctcaaacgtgatagatcaatacgcagtggatctatcaaaatactacatgcacccccaaaatatgtacaactacagtatatctattacaaatttttttaaaaagagggccggccgggcacagtggctcacgcctgtaatcccagtgctttaagaggctgaggtgggtggattgcttgaacccaggagttctggactagcctgggcaacacagtgaaacccagactctacaaaaaataagcaaacttagctgggtgtggtggcgtgtgcctgcagtctcagctacttgggaggctaaggtgggaggattgcttaagcctaggaggtcaaggctgcagtgagccaagatcttgtctctaaaaaataaaatcggctgggcgtggtggctcacgcctgtaatcccagcactttgggaggccgaggccggtggattgcctgaggtcagccatcctggccaacatggtgaaaccccgtctctaccaaaaacacaaaaattagccgggcatggtggcacacccctgtaatcccagctacttgggaggctgaggcaggagaattgcttgagcctgggaggcagaggttgcagtgagccgagatcgcgccactgcactccagcctgattgacagaatgaaactctgtctcaaaataaataaataaataaataaaacaaaatcagataaaaataaaacaaaattgcagctggattaaaaaggccccagtaagtcaggaaccagggagagagatactgagggggcagcttgctttcaatgatggtcctgcctcaaaagcacacctaccaatgtgccaccccttatctgtcacaccctgtcacctggagggtgttaggcaaagtgcctcagcaaacgccagcccgtgctgtttgctctggctgtgccctttccttctggcgttccccagccatttcatcctcaattcccagtgagaaccctggacattttgcagcctggggactaaattctaacaggagggtcaatcatagcaatgatgatgatgatgatgaccacgatgatctaatagctaatacttacacagtacacactatgtgccagggagctgttagcagagtttgcataactcagtctcgccacaacccaagaaagcaggcgctactgttatttccatcttatggatggggtaagttgaggcccagactggttatgtcacttgcacaagttacataactggaatctgaaaccagatcacctggctccaaaacctgggctctcaaccaccatcagccatgagccacatcatctgatgacattattccagacccgtatcaacccccaacccttcctgcaggaagatatttcatttgggtccaaaaatacttgcccaatgcctgctccacgccagcccctgcattaggcaaaaacgtggattgtaacggaacaggcaaaacctttgtcctagtagagtcacgctctccccgcctctgcagcactcaggtgagctgcactgtggtttcacaggcccatgcaggtgtgtgtatagctgcaggttttatttccctagcctcacagcctcaagaggagagataaaatgtgtatattcagggatggaaaacacacacacattttctctctcccatcaaggctgtgaggctacggaaataaaacctgctaagaataaatatacggagaagaaaaaacaaagccttggagtcaggccagagtctgagtcccagctctgctgcttggtagctgtgtgaccttgggcaagtcactttgtctctctgtgccttagtttcctcatctgttaagtgggaacaatcagaatacagatactaggaatttaatttttaagttttgggggaggcataacgtcactttactcttctgcttctgcccatgacagaaggaaactgacatttactgagcacctacagtatgcaagactagctgccaggggctttctacatgctcctcacttaatcctgaaaacaaaccctccactgtggcacctgggggtacaatggtgatttaatgaaacctctgtccccaggggtccccattgttcactgccctctcttaggactcaggcataaaatttatccccaatctgtagatgatgaaactgaggctcagaacggttcatgtaaattcactgaaaccaggcattcaggtaatagaggaggagaggttcaagctccaaagccagtatctcctggtatcgctgacatagagtaggcactgataactgcccctcggagactacacggcaacaaagacctatgtacatccatagaaggctctgcagaggatctggtacttcatattgtcacaagagaagtttctggggagccctgcaggcagagaaggagggagatgcttagaatagattcaaacacagcccaggttttttggagaggagcacaacttgttatctctagagggtaactgaaatcagccagtcatgaggagtgcagggagggtgctattacctccacctttacaacatcacctcttccactaccagtgacccagtttgcccttgagaaatcactccgtccacaactttctgtctccggtttctaaagggatgactctacccatttataggaccaaagctggagtcatagtaatggaagcggagattgtcatatgacccaacctgagccaatgagaattaggcttgggactttcattgtaactaccaggaaaaagtctttttctgcttcagtttctaaaccagtgggatacaggacagtagctcctaggagctatctttgccacaacataaaaagggcctgcctgtggatggaaccatcacagagggaagcagagccaagagctgaagaaacagagattcccgtctcgagcatctgagcctgaagccactatgactctaagcttctgttatgccaacaattttttttacctgaaccagtctgaagtgggtttctatcacttgcagaaagagttctgatttctttttttttttttttttacacagagcctcgctctgtcgcccaggctgaagggcagtggcgcgatctcggctcactgcaagctccacctcccaggttcacgccattctcctgcctcagcctcccgagtagctgggactacaggtgcccgccaccacgcctggctaatgttttgtatttttagtagagacggggtttcaccgtgttagccaggatggtctcgatctctgaccttatgatctgcctgcctcggcctcccaaagtgctgggattacaggcatgagccactgcacccggccgaaagagttctgatttctaaagtgacccagctgaaccaagagccaaactgggattcagtatctggctgtttgctaagtaggtgatgcctcaaggattctccctgcatgggaatttgtggcaacttttttggctgaaagaggcaagaggagtaaggtaccagcattgctggataaatccaggactgctgaagggagtgttgtacgctcttgcaatgaacagaatggaagaatatcggcatatttattctcagcacatcccaaaggacatccagaaaaatccagggagactggggtgggggaaacatagccgaagtcctctagttagacatgtgaactccaaatatgagagacaggtctcagttaatttagaaagtttattttgccaaggttgaggatgtgcgcccacggtaccgcctcaggaggctctgacgacatgtgcccacggtggtcagagcagtttggttttatacattttagggagatatgagacaccaatcaccgatcaatgtatgtaagatgagcattggtactgttcagaaaggcaagacaacttgaagtggggaggaggcttccaggtcataggtagataagagacaaacagttgcattcttttgagtttctgatgagcgtctccaaagggggcaatcagatatgcatttatctcagtgagcagaggggagactttcaatagaatgggaggcaggtttgccttaagctgttcccagcttgacttttccctttagcttagtggtttggggccctgagatttactttccttttacaggcacatggaggcattgaatactgaagtgtcccactttgtgccctcaggttggtgaggcttacagttgctcaggttacatgagaatagggtcacataaacagctgtcccactgtgggcttggttttctgcaaggtactgagttccccattatgccaggtgtgtaagcagacgctgtaacaggagagagggcagtaagttatggcagcattttttttcttttttcttttctttcttttttttctttttgagatggagttttgctgttgttgcccaggctgaagtgcaatggcgtgaccttggctcaccacaacctccgcctcccaggttcaagcgattctcctgcctcagcctcccgagtagctggtattacaggcatgcgccaccacacccagctaattttgtaggttacagcagcatttctcactggtccatggaccatcagcctaacagttacttgcagttgctccaacatgtgtattcctgggccctgcacagacttaatcagaacttctatgaagtagtctaggagctggcatgttttgctacctagcccaggggattctgatgcacaataagagaatatccggtaacattagcacttctcaatcttaaaagtacacacatggtcttgggactacgttaaacacaaattctgattcagaaggtttggtataagagactgaccatctgcccggtgctgatgctggttcacaggccacagtctgaggagccaggagcttagatgatgacttcaacaatgtaatgccagccctcacaccgtacactcctatggctgaagactggaccacacactggtacagaagaccagcaaggacaatagggttccattctaccaggcaaggccaggaggaaacaaaaccagtctcatgaactggctgaatagttccaaagagacaaaagctctatgggcaaagagagagatgcgcctgagatttaagtttacatgataaaatggtaactgttatttactgaacagtactgtgtgcaggtggcatattctggccactttaaaccattatctgagctggcatttaccatagccatataaagtaagcaccagaatctccactgtgtggaggagcaaactgagatgaatgtggttgacattaaataatatttgagattattctgccttctaggctcatggtagggctgcacttcctggctccttgtggatggggccaatgagctgtgggtgggtatgacatgctaattttgggtggggcccttttattgtgggttcaagcccctccaatgctacctttccctgtcactgtgactggcaacattcaaatgatggctgctccaacagctggaccctttggtgtggaaaaaacagagcctcaccatttgacctatgagagacacacagcatgcatgataaataaaatttgttgtaaaaagctgagttttaggactgtttgttactgcaccatataaccttgtatagcctgactaatacacataagtttcaacagctagaatttcacaaggccaggatttaacctagatctggttgactccatagtctatgttcactcaattcaatgtagggaaagatactggcatccacaaatctcagccgaaccactctgtcaacagaatgagaaggacgatttccaggagctgggctgacataggaatgagaggttactcatggagacatccatcagatcctgggggactgtggtgagtagaacaagagccctggtcaagcctatgtgggtcacagaaacctcatcccagagcaagcagctcatccccaggccagcacagggatagggaaagaccctggaggtgacagcagaaaacagcagccccaattatagtctgacccaggctattgagcccacctgacccaatgaaagccaccaccaaaatctgggggctccaacagataggcagaactgatgacaactgaagagagaggaagagaacagagagagacaacagccaagaaaacaggccctatcccagagcaggccaagcctcaccatgttgtcacttagtcatgctcaaaggatgctacaggaaggaaggggcacctgctgggtgcttctgtagaagaggcaggcctcatggggtacgatgaaagggagcctgactcaacagatgaggcagggcacccatgggcaagagacccagtggagccgctgctaatgaaagaaaagggtacttgcactatccatggttctgaggctaaagctgctccaccaagtgggtctcaaacatattagtgacaatagctgtcgctttgtactgagtgcaggtaccatcattatacccttttccagattaggaagctgagacatggagagtttaaacaacacgcccaaggccacccaactaacaagtggtggagccaagatcccagcccaggggatttgactcttcttctgagactgagtcttgctccgttgtccaggctggaatgcagtggtgcaatcatggctcactgcagccttgacctcccaggatcaagcaatcctccctccccagtctcctgagtagctgggactacaagtgtgcatcaccacacccagctattttttctgtatttttttgtaaagacagggtttcactgtgttgcccaagctggtctcaaactcttgggctgaagtgatcctcctgctttgacctcacaaagcactgggattacagcgtgagccactgagcctggctcagggatgcgactctgatcttactcttcctccctcagctgtgttcccataggctcttgtggctacacaacatctgctctgtcctcaagtggggtgattctgtcgatgtctggagagactttggtttgccatgccttgtggattaactaggtgctactggtgtctagtaggtggaggtcagggaggcttctaaacactctataatacaccagacagccctcaacacaaggaatgatttggcctcaaatgtcaacagtgctgaggctgagaaaaccaatgttagaccagcactatccaacagaaatacaatcaagtggtcaaggcccggtagctcacatctgtaatcccagaactttgggacgccaaggcagggggattgcttgagcccaggagtttgagtttagcctgagtaacacaacaagaccttctacaagaaatcaaaaaattagctgggcatggttacacatgctgtggtcccaagtacccaggatgctgaggtgggaggatcgattgagcccaggaggtcaaggctgcagtgagccatgatctcaccactgcactccagcctgggcaccgaggccacactacccataggctgctcccagccagaagcgagcatgctaggtactagtgccacctgttcctgcaggcaagagagtcctctaatagtcaacagtccaccagagactcccaactgatctggccaaatgttcctagagctgtgtgttgtgtctcagactcctcctgcccaaccttcttccttcaccctctccccttcatcagctggcttactgttcacttcaaggtcaagacattggctgtctgatgcagggacatccctggcacggcctccatggtcatctagcaaggggagggtggagcaaaggcttggtcccatagcatatattcacccatctccttgtccatttgttgtcttccagcagaatgtaagctctgagaaggtaagcagtttcctctcctttcctacaactgctgtcttccttgtatctagcacagtggctggcacaggctaggtgctcagtaaatatctggtgaatgaacccaggtcccctgaattctctgcttcatttcacaaagctgatctgagcacctattaggtctacaagctgtggcaggtattggggataagatctgagcaagacaggacccttgccttcaaggcactgagttctcaaaggcaagatggtagctatacagctaggcacagaattgtgtgactacagactatggccacagagctcctccttgctgacagctggtgggagctggtgttggctttgtttactgagcatccctacaaagggatttggggcttatgtaatctgaactcaaccagaaggtcagagaaggcttcagaccaaagtttaagataaagaggctgaggcaaggctccagtcccagagcatccccaggaggcctaccctgttcttccatgaatgtctcttgattagaaactctagagtctaggaggtcaaggtgggaggaacacttgaagccaggagttcaagaccagcctggacaacaaagcaagacctcatctctataaaaaataaaaattaaaaataactaaaaataaaatgagagacagagagagagagagagagagagagagaggacagaccagcctaggcaacatggtgaaaccctgtctctacaaaacatacaaaaattagctgggtgtggtggtgtgcacctgtggtcccagctactcgggaggctgaggtgggagagtcacttgagcctgtgaggcagaggttgcagtgagcagggatcgtaccactgcactccaagtctaggtgacagagcaagaccctgtctcaaaagagagagagagagattgtgagaaacagcagagtctgactggagctgaattattgagctcagcctgggaccaactgtcccacccactgaccagcactgaggacagagggtaaaccctgcaaaggaacatttttcatcactccaagacctgatgttaaccacactgaggcttcacattacacagaacacaatgacaatgttctggttatgtttcttgaaaagagtttttttttttttagagatacacattaaaatatttacagatgaaatcatataatgtctgcacgttgcttcagaataatattacaggggagaagggataggctgattcaggccattagggcctggtgaaggtacccgagttctgtctatctttaggttaaaactttttcatcataaaaggtttcctgaaaaaagcaagaaaatgtaaaaatatatatatatagattacatgtggacttggagcagccaacaccattgcttcctgtccccaccagcagccaagactcctcaagctgaaatactggggtcggccacacctttgcaccacagcttcctttgttcttcctgaagtctttcctaattgtgctggaatgcaggcattgcagcagggaatcccctgttccaaagcctttgctggatttttttttttttgaggcggagtctcgctttgtcgcccaggctggagtgcagtggcgccatctcggctcactgcgagctccgcctcctgggttctcgccattctcctgcctcagcctcctgagtagctgggactacaggcgcccgccaccacgcccggctaatttttttgtatttttagtagagacggggttttaccgtgttagccaggatggtctcaatctcctgacctcgtgatccgcccaccttggcctcccaaagtgctgggattacaggcgtgagccaccgtgcccggccactggatcttataaatcacaggatttcagaggagatgcggccctggatcagatactaacatcttatgtcttcccttgagtgctgggaaaggggaggttggagactgggaaacattttgccatttgcagtcttaggagatctttgtaaagatttctccctctggctggttttgaccaggatattgccaaattccacgtcttggtttctggatcctcccgagcctttgagtttcccgtgaggccacagctgtagggaggctgagccaagtggccataacaaccaggcagagtagcaggaagaagcaggggcagggtacaagcctccccctcaggaggggaacttccctgtgccaaggggaatgaagggacccaggagatgcacagcagacccagtgccctacctctttttatagtccaggtcccccacagacccctttatcagctggcttactgttcactccaaggtcacgacagtggctgtctgatgcagggacagaaatccctggcacagcctccatgttgtccctctgcagagacaggaggactcaggcctggccatgatgctggagtcaccgtggatataggccctggcccatttgactcaagaacacatacataactggaaccaagaggctggcgaatcctctcaagaccctggccacttggaagaccctaagcctccttgcaggtggccatactaagcaaagtcacttgcagccacccttccacgatgcgttctacatcacccagctgtgaaaaccacccacccccatccccatccccttcacactcatgccttcctcctgagctcaaggggccctggcccaaggttcctttagaaccaggaaggaggttttgtccctctgaaaatcatccttttcaaacagaaggcatttatcttggccaggcttaaaagacaaaaagatgatagctgagctctagggcccatcccacagacaatatccagaaaccttctccccacaattcccacaccagcctcccagcagctggatcttttctccacgggatttgcctacaagacttctctccggctttatctcaggcgggtttgtcaggggagcaatgtcaccatccctccaccaaattcacctcaacaacatttactgagcaccaagtgtgtccccaccgtggctcagccttcccacgcactgtcctgatttaaccccacgtgcttataacccaagggagaatcactgcgatattttatcaatgtaaagacacacatcttaattgttcatattttcatgcacctgaaatttgggtaggtcttctaattacaactgtgacatggctgtcccgcctggtcccatacagactcagtcacagcagttcatagcattgtcactttaattaagttttgggcatggttgttacttcaaatgtggagtgtaggtgctattttaaatgtcttcaaaaagattcaactgtgattcagctttgaattgaaaagctattgtgcacacaggaagcctgggaacagagcagcagaatgcctgtgcgatgctggcgaggcagacacatattcatccctgcagacaggcccacaagtccagattttcttgcaaagcaccaaccaaatacttaaaaacttaaaatgggacttaaaaaccatcccaggctgggcacagtggctcacaactgtaattccacagctttgggaggccttcaggattactgaagcccaggagttggagaccagcctggacaacatggtgagacccccatctctacaaaaaaaaaaaaaaaaaagaaaaaaaagaaaaaacttaaaaattacctggacatggttgtatgtgtctgtagtcccagctactcaggaggctgcggtgggaggatcgtttgagcctgggagttccaggctgcagaaagctacgattgtgccattgcattccagcctgagcaccaatgagatcccatctcaaaaacaaaacaaaacatccccgggatgagtggacacacttgcaagaaatgcctcacttcctgtgcttctcgattaggggccaccaaatgtttcatgcaaagggtgatagggaatatttttggtttgtaagctacacaggctcagctgcaaccactcaactctgccatcagggcctgaaagcagtcatagggttgtaactatgctccaacaaaacttttttttttttttttttttgagacggagtctcgctttgtcacccaggctagagtgcagtggtgcgatctcggctcactgcaacctccgcctcctaggttcatgccattctcctgcctcagcctcccaagtagctgagactacaggtgcccaccaccgcaccaggttaatttttaaaatatttttggtagagacggggtttcactgtgttagctaggctggtcttgatctcctgacctcgtgatctgccggcctcagcctcccaaagtgctgggattacaggcatgagcctccgcgcccagccccaacaaaactttatttgcaaaaacaagtggaggaccacatttggttcatgggtggtagtttgctgtccctttctcttgatagaacagaaaacaatgtggaaaaatgagggcactgatgattttaagtcaaaagtgatacagaagatgaactttgaactaaaaaaaaagttttaagaatatcttacttcaatgatattttatctgtgtgtacttacaaaagtgatgtgtgattaaaaaaccaaacaaggggactgccatcagcaacagccccaaagcccactgggctccttggtgggttgtgagttcagcagcctcagcagggtgcatcagtcgagcacagctaggactccccacaacatgcgtgtcccaggctggcactgagacacagcgctgatgttgctgccgggggctgctgatggcactggtgctggtgctggggtggctgctatgggtgagggggcgtcaaggaagagcacagtagtgtgtagatgtgaaccagggtccccaggtggtcgcctttgaatgggccaatgtccaagacctgtacatgattgtgctctgcatccttgcagccagcctggccaagactggttctacctgtcccacaaggtcaccagcatagtccctgagagcaccctgctcatcatcctgggcctggtgctgggcagcatcatctgggtggccaaacacataacatccttcatgatgatgtccctcatcatgctagatgccagctacttcatccccaactggctcttcttcggcaacctgggcaccatcctgctgtacaaggtcatcagcaccatgtggaatgcatccaccaccatcctgtccctctatgacgtctctcttagtaggctcatgggctacctgcagatagggctgctggacttcctcctgttcggcagcctgatcaccactgtggacccagcagctgtcctggttgtgtttgaggaggttcatggcaatgaggtcctgttcatcatcatcttcagggagttgctactgaatgactctgtcatcatggttctgtacaatgtgtttcaatcttttgtgacactgggtggtgacaacgtgaccagcatgaactctgtggaaggtgtagtctccttccttgtggtgagcctggggggcatgctggtgggaatggtctttgcctttctgttgtcactggtgacccacctcaccaagcatgtgcacatcatcgagcctggtttcatgttggtcatctcctacctgtccattctgatgtctgagaagctgttgctgtaggccatcctggccatcatcttctgtggcatctgctgccataagtacatgaaggccaacatctcagagcagttggcccccaccatgtgctacaccatgaagatgctgaccagtggcaccaatcccatcttcatgtccctgggcaccttagccatgaacctgctcatctggacgtggaacaaggcattcatccgcctgcactggccttcatcttcaggtactgaggccatcagtgtcatccactcctggctcctggactgctattggatggtgtggctggaaatcataggccaggtggtcatgtcctgtggaggcctgcatggggccatggctttcatcctggtcatacttctgaatggaaacaaggtcaaggagaagaacctgtttgtcagcaccaccgtcaacatcttcaaggtcatcttctggggtctgaccatctagtccctggtgcagtggctgaaggtgaagaggagtgagcactgggagcctaagttccatgagaagctgcaatgccaccctctcgaccacatcctcttggccatcaaggacatatcgaggcatatcaggcacaatgatctcaaagacatgtggtcccactttgacaggaatttcctcagtggagtcctcatgagaaggctggcccagaagtctccagaagggatcctcaatgtcttccatgcactgaacctgaaggatgccatcagctaagtgaccaaaggagagtgcctgagatccctggccttcatcggctccccaagtactgataacgtggtaaacgtggacttcacaccacgatcgtccaccatggtggcctctgtctcctaccacctgagggagaacatcagcaccgtctgtctagacattcagtccctggagcagcatggcagagcattcggtacggggaggacacggtcatgcaccacatgctgcagcaatacctgtgcaagctggggaaggagtatatgcatcgctacagccacaccagctgaggacaagaagcaggaccgagatatcttccacaggtctatgaggaagcacctggaatccttcaagtagaccaagctcaggatcacccagaacaagaaggcggccaagctgtacaagccaaagcgtgcccagaaacagagaactcccaaagctctgtacccgctccagcacagctgcactaatgccaacccaggccagggcctgggcctgagcggccatcctacactgctgaacaaaatgaatttgcaaaagtgataccccaggcaaggctccaggcccctcccagcccagcatctctccccagcacggtggggtgcatccagagtgccaggactcagggcctgaccctggagtggctgcaggcccagcaagtggcccaggctcaagtgctattttcaggtccttagcagtttgttgaactgctgggtcacctcgtgcgctgcaggtaaagttgcaggaatgtcttctgtttgctcagcacttgcgatttagactccttgaaccagcacctgccccctttccctcccagttaccatcctgcccttgccagctttggaggtggaagctctgggtggctgccatgcaaatgcctcttctggatctggtatcgcaaggggggatagagggatgaggcctgaggtgaccttgaggtcatttaaattttctaaattagacaaaacaattaaaaaaaaaccatattcccatgccttttaaaaatcaaaaccacgtactgtttcttttcagtgtaagcagttttaattacctaccaggtgcagagtctaggatacaagacagaactgcagataaagtctctttccagcatagctaggagacatggctcactccacctgttcccaggcctcacctagaaatctaatgaatggctccaaaccaggtaaactagataattttccaaagtcaaagaagcagtttatgacattaaagcacttagccaatttaacctctgacttaatttagaacaaatgtctaaattttaaagacttttttaccaataattttaaaactgtatttcccaaagattactgaagtcatgtgaaataaaaggcatgagagtgtctattcttctgacaacatatttaagaggtttcattttctcttaatccaattaattagagtaccttcatataagcatcacacacacaacacttctagacaggagaagatctagcagttgtaagtttttctttcccatcttatgactttctgacttgtcctatattttgctctttcctagtcattctactttaggacaagaatttgccatacaagatgctctctcacataaaatttctttccttcataacctatcttacataaatatatcttcatatccacaactttttcttttcttcttttttttttttttttttttggagatggggttttgctcttgttgcccaggctggagtgcaatggtgtgatctgtgctcaccacaacctctgcctcccgggttcaagcaattctcctgccgcagcctcccaagtagctgggattacaggcatgtgccacaacacctggctaattttctatttttagtagagacggggtttctccatgttggacaggctggtctcgaactcctgacctcaggtgatccgcctgcctcggcctcccaaagtgctggaattacaggcatgagccaccatgcccagtttccacaactttttttagatctctctcccctactaatttctgatgcccacccaaatcaaaaaggtcagataaagcaaggcaaaacagagtagagccttagattttgagagggacctgtctgcttacacttcttgaagttccataaggaaaacagacgtttctcctaaaatggagtctatggcaccttctgtttttcctaaggagtcccaggttgtcaggaattaccttaggtcctctcatatgagcatcaagagtggcaagaagacagactagggaaataattcagtcaactgagaagaaaaagaaaaccttagtactgttccccttgtaaagatggataaatggaggcaccatgcatactgtacggaacccgcccaggcaatgcaacctgggatagcatgcccaacgtgcccccgtggagagcagtgcagacccagataccacacctaccctgcttccttttctaccactctggccatactcccactgtgggctgccctcctaccgctctccccgctgcagtctccatggccaccaccaacctcagctaagcgaaacacgttgccacacgctcaagcctaccgcatccagcaggcgtcttacccttctccttctctaagctgggcaccgaacatcagggtatgcagacacaggagagcccggtaatggcctgattccttgccccctcagccggctttatatagggaggttttgcaactgagtgcctggactacatattctgattggatgagagaaaacgtctaggcctactctgattggactttattgtcatgttctgattggttgccttaagaattgctctcatccaatcagaacatgataataaagtccaatcagagtaggcctagaggtttttctcccatccaatcagaacatgtagttcaggacccagtggtgtaacttccctatataaagtatgctgaggggacgtcaggccattgcagattctttagtgtttgcctcctcagcggctcttgcccggcttagaggaggaagaggcgaaaggaaagacacctccctcactctggcctaaggcaccacggctcacctcactgctgtggttggtggttgctgccacggagactgaagagccaccggagtagtaggagggtggcccacagtgcaggagctgctcagtgcccggcttaaaggaggaagagaaggggaagacccctgtcccaagctggaggctggagctcttggcacctcggctggcctctctgcgattggtggctgtaatgaagactgcagccccgcctgagcattaagaaggagaaaatagtttttgggtaaatggagggagaaaagagagtggcaggtggaaggagtacagagagagtagtaaaggggggaaaacacgggggcgagcaagagggagaggaagttttgcgaaaagagagtggggagaaaagtttttgggtagatagaaggggaaaagagggtggcaagcaggagccataaaagatggtggggaaaagagtgggggaaaagtttttgggtagatggagggggaaaagagggtgacaagcaggaggggggaaggagggttgggaaaacgacggaaaaatagttttggggggcagatggagggtgaaaagagggtggcgtgtgggagaggggcgggagtggggaaaagaggttgttgagcaggagcggggagaaggctttgtgaaaagatggtgaggggggaaagacaagaaaaaggtttttgggtagatggagggggaaaagagggtggtgagtaggagggggcaagagtggtgagcgagggagacaaggttttccaaaaagaccatggaggaaaatgtttttgggtagatggagggggaaaagagggtgacaagcgggagaaggaaaaggggtggtgagagggagggagagaaggttctgcgaaaagaaggaagacagaaaagaaagatggtgcagaaacaaaaaacgtgggtaaaaagcttttgggcagatggaggggaaaaagtggcaagtgggaggagaagagagggtggcgagagggaggtagggaagaggattgggaaaaagatgatggggaaaatagttttggggtagatggagggcaaaaagagggtggcaagcaggctaggggaaagaagagggcgagcgggaaggaggaagggctttgtgaaaagacagtggggaaaaatttggggggtagatggaggggggaagagggtggcgagccgaagtggggagaaggctttatgaaaagacagtggggaaacgtttttggatagatggaaaagagcgtagcaaggaggggaaaaaagacgatggggaaacagtttttgggtagatggagggggcaaagagggtggtgagtagcaggagtaggaaaaaggctttgggaaaagatggagggaaatgtttttgggatgatggaggagcaaaaggctaatgagagcggaagggggaaaaagagggtgggtaaaaactgtggggaagtttttgggtagatggggaaaagagtggtgagtgggagagtagagaaggtgttgtgaaaagacggtggggaaaaaatgatggggaagaagttttggggtagatggaggaagaaaaaggatggcgagagggaggggtccgaaggcggtcaggaaaagaaggcagggaaataatgatgggggagaaagcttttgggtagatctttttctgatttttaaatcagattatttgcatttttgtttttgagtagttcttgtcttctttatatattttgtgtattaacccctcgcctgatgcatagtttgcaaatacttccattctctggattatttcttcattctatggattgcatcctctgctttgcagaagttttgaagtttaatgtaattccatttgtctatttttgctttttctgcttgtgcttttgatgtctatttgaaaattccttgtcctaaccaatttcctaaagtatttttcctatgtttttttctctagtagtttcatagtttcagatcctatatttaaatctttattttgagttgattttcttacatggtaagataacagtctagatttattcttctacctgtgggtgttgggttttcctagcacagtttattgaagagattgtccttcctgaatgtgtgttcttggtgcctttgttaaaattgagttgactgtaaatgtgtgaatttatttctcagttctctattctgtttcatttgtctatgtgtgtctgtctgtcatttgtctatgtctgtctctctgtctctccccgccccccccccttttcttgccagtaccatgctgttttggttactatagatttgtagtatattttgaaatcagtgtgatgcctccagcttttttctttttattcaacattcttttgtttatctgaagatattttgcatttccatgtgaattttaggctggtttttttttgtatttctatgaagaacatcttttgtaatttaacatggattgcactgactctgtaagtcatatattgggtgacacagatattttaacaatattctttctagtgcatggacataggatagctttctatttacttgcatttgctttaatatctttcatcaatgtgttttatagttttcattgtgggatcttttgcctttttggttaagtttatccctaggtatctttttttggtgagtactgttaatgaaatagctttcctgatttttcttaggtgtttcactattggctcattggtgcgctactcatttttgtatattgatattgtgtcttgcaattatactaaatttattatttctagtaaaatttttagtggaatctttagggttctctattatatgatcatgttacctgaagacagagaaaatttgactcctttttttccagtttggatgccttttattcatttgtctaattgcattctcttgcctaattgctgtagtgaggacttccagtactataatgaacaaaagtggtaaaagtagccacgtttgttccagattttagaggaagagcttttaaattttccccattgattatgatgttagcagtgggtttgtcatatatggcctttattgtgctaagtaatgtttcttttgtattcattttgttgagtttttatcatgaaagaatgttgaattttatttttttcagcatctactgaaacgattacatggtttttgttgttgatttgctgaatatgatgtatcacatttatttgtttattgaatcatcctcattttcctcagatgaatcttgcttgatcatggcagattatctttttattgtattgtcaaatgcaattttcaagtattttgttgaggatttttttgcatctgtgttcatcagggatatttgtctgtggttttctttttgtgttgtgtcctggtctagtttttgtaccagggtaatgctcgccttatagaacaagtttgaaagtattcctcttcatattttggggaatattttgagtaaaatcggtattcgttgttttaaaaatgtttggcagaattcagcaataaaaccatgattcgtgtgtttttcttcaattgacaggagactttttattactgctttaattgcattactcattattcgtctcttcaggttttttatttctttatcattctatcttgggaatttgttatatgtccagaaatttattcatttctcctacatttttcaatttgtatataagtgtttttagtaatctcttagaatactttgtatttctgtgtgatcaactgtaatgtctcctttttcgtctatcattttcagtttttcttagtctagttaaagcttgtcaattttgacttttttccaaaaacaaaaaaaccccagcttttggttccgtttgactttttgtattttttttagtttcaatttttaatttttttctaatctttattattttatttctactaatttgatttttcttgtttttctcattacttggtgtattgtcaggttgggtatttgagatctttctacttttatactgctgtgttgacttctttacccttatataattatctttctagtttttctttttttgacttaaagtctattttatcagatataagtgtagctactcctgcttttttgtttccatttgtatgggatatcttttatcatcctttcattttcagtctatgtatgtctttataggtgaagtgagtgtcttagtcagtatatagttgggtcttgtctttaaatccactcagccactttgtcttaattggagaatttaattcatttatattcaagattattactaacaggtaaaaacatactgttgccattttttacttgttttctagttgttttgctactctctttttttgttttctcctttcctttctcttctctcctctctctctcctttcttcctttcttttccttcctctttcccttccttcctgtctttatttgtagtgaggtcattttctctggtagtgtgttttaatttcttgcttttttatttttagggtgtctattactgatttttgttttctggtcagcatgaggctaaacaacataattataacgagttattttaaactgaagaaaacttaaccttgattgcaaagaacaaaaaagagagaaacaaaaaaaactaaaaacatttaccctgtaactctatcccccgcaacacacacacattttgtatttagatgtctttcagtatttttttttttttttttttttttttttgagacggagtctcgctctttggcccaggccggagtgcagtggcgctatcttggctcaccgcacgctccgcctcccaggttcacaccattctcagcctcccgagtagctgggactacaggcgccagccaacgcgcctggctaattttttgtatttttagtagagatggggtttcaccatgttagccaggatggtctcgatctcctgaccttgtgatccgcccgccttggcctcccaaagtgctgggattacaggctcagtatgtttctatattgcctatccctttaaaaattgttgggttatattattattttaacaattttgtattttagccttcacatgaaagatataggttgcttatacatcacaactatagtattctaaatttatctgtgtacttttagtaatgagatttataccttcagatggtttcttgttacatgttagcatcattttctttcagactgaacaactccctttagcatttcttgtaaaccaggtttggtagtgatgcatttcctcagcttttgtctgggaaaagtatttatctcttcttcatttttgaaggatctattctttgggtgtggtttttttcattggtattgtttttcttaagcactttgaatatgtcatcccacttctcccataggagggaggccctcagcctgtttaatttttgctgagaactctgcttcctgacatatcaaaggtcctcaatatgttgtttgattcacttctcttgctgtttatagtatcctctttgtccttgacatttggagttggattattatatgccttggcatagtttttttttttttttccttgagatggagtctcgctcttgttgcccaggctggagtacagtggcacagtcttggctcactgcaacctctgcctcctgggttcaagcaatcctcttgctcagcctcccaagtagctaggattataggcacccacgaccatacttggctaatttttgtatttttagtagagatggggttgcaccatgttggccagggtggtctcgaactcctgacctcaagtgattcacctgcctcggcctcccaaagtacttgggattacaggcctgagccaccgcacctggccactttggcgtagtcttatttggcttgaatctgcttgatgatctttggtcttcatgtacctggatatttatatatttctcttgaattggaaagctttctgttaccatctttttgaataagctttctactctttctctgctttctcttgaagaccaatgactcttaaatttgctcttctgatactatcccatagatttcctaagctgccttcattcttttttttcttttcttttttctcctattgtgtatttcaaatggcctgtgtgagctcactgattctttctctgttggatcagttctgctgttgaggccctctcatgcatttttcagtgcatccattatatttttcagctttgaggtttttgtggtcttttaaaattatttcaatctctttgttaaatttctttgatacatttccgaattacttatatttttaaaattgcattgattttcctcaaaacagctattttttacctccctctctgaatagtttaacatctttatctctcctaggttagtcactggtgacttgtttattgtttggtgaggtcatacttccctgaatgttcttaatgcatttgggcctatgttcatgcctgggaattgaataagtcagtatttattccagtctttgtagtctggtcttgtttgtacctgtcctcctctagatggtcttccagaaattccaagggtactgactattgagttccctaaggctggggtcactgaagctgtttcagcaccagggtgccctaagctcaggttcactgtgactcttgcaggactgaggtcccagagggccctgatggacttggagaagataagggaggggttccctgggttcccaggcaaagtgcttcattcacttccctcttcttcccattggaaggagtctgggtactaagctttgtggatctgggagaagggtggcttgggcactcccatggccactgcagctggcaccacatacccgaagcccacagcctctaggaccagagcagcactggggcttgtctgagtcctgtggccactactgcctgactgctgctgacttatgtaggtcttgaggccgagctactctgctggtggtgaagctggccagggtttaggtccatcccgccagggcagcaggttctcttctacctccaggcaggtctagaggtgtctgggagctcctgcctgggatcagggccactgtgttctgcctgatgctgtgtccaccgtggtggagcctggactgggttctcctctttcctgcataggaaaggagttctcccggcactgcactgcctggagttgggattagggtaacacaggcagccctgtggccactgtagcggatgtcatatatgaaacccacagcctcccagaccagcacatcattggttgctggggctcacccaaggaccacagtggctatggcctgcctgccactgaaatttattcagagcctgaggccactttaaacagctggtggtgaaggaagtcaggactcaggtttgtcccaccgggcagtggattcccttctagcccaggtcatgtctaaatgctctgtctgtgggcaccggccatggaatcaaggaccatggggttctgcccagtgctgtgttttactgtagcagagctggtactgggctccaaggcaaagtttaatgcacactctcttctccctcctggaagtggacacattgtctctctgcactgcctggggttgagggagggatggtataggcactgcaagactgtcttttccaccctgtttaatgtgtcttttcttgtttttaagctaaaaccaggttctgtgatctgtcacctgatttctttggctcttgtgaaggtattctcttgcttagattgttggtggttcaatttgatgttcctgcagggagacaatcttgtagagttctattctgccatctcgctccaccacttctcatttatttaattgttcttcaacttatttcaacaatattttgcaggtttcaaagtatgaattttgcactgctcttgttaatttctaaatttattacttgttttgttggtattatacatgggtttgtttccttaataccattttaaagcagtttattgatagtatatagaaataaaattaaatttttagtattgcatttatatcttgaaactacgtcaaatttatttctaatagtattttactgaatttcttagaattatatatgagatcgtgccatgtgtaaatataaaaaaattattttcttttcaataaggatgttttaaattttccgttctttactacacctcgctacaatctacaatataatgttgaatagaatttgcaagagtggacattcttgtaactgattagtcattcaccctctcattgctgagtataatgatagctgtaagtttcataggtaactaccactagtttcaggaagttaccttattgttcgtaaatttggagtgttttgttttttttttgttgtttttttttttttttggagacagagtttcactctttttgcccaggctggagtggtacaatggcgaggtcttggctcactgcaacctccgcctcccaggttcaagcgattctcctgcctcagcctcccaagtagctgggattacaggcgcctgccaccatgtctggctgagtttttgtatttttagtagagacggggtttcaccatgttggctaggatggtctcagtctcttgacctcgtgattgcgcccgcctcagcctcccaaagtgctgggattacagttgtgagccaccgctcccagcctggagtgtttttattattagaatgtgtgatattttctcaaatgctttctgtctgagatgcttatatatttttgtcttttattctgttaatatggtgtttgcatgcaatgattttcaaatattaaatcaatggtgcattcctggggtaaatcacatctgcgtatagtgcataatctattttatatgtttctggattcagtttggcaatattttgttgaagacttttgattttataaaacaatgtgctgggcgtggcggctcacgcctgtataatcccagcactttgggaggcctaggtgggtagatcacctgaggtcaggagttcgagaccagcctggccaacatggtgaaaccctgtctctactaaaaatacaaaaattagccatgcatggtggtgcacgcctgtaatcccagctacttgggaggctgaggcaggagaatcgcttgaacctggaaggtagaggtcgcagtgggttgagattgcaccactacactccagcctggatgacagagtgagactctgtcacacacacacaaaatgaaagatactgttctatattgttttgtgatacagttttggtgtcagtaatcctggctttataaaatgaattgggaagtgttctctccccttttattttctgcaagagttggtgaacaattgatattaatttctcagtgtgtttgatagattttgcctgggaagctacttgagatttttattgtaagtttttaaaattacaatccaatctttttaccttctgtagatctatttcgattttctatttctccttagtcctttcatctattttagtttgtgtctttctaggaattcatccattctatctaggctatctgatttttttaacataagattttcactgcattgtcttgtatttttattttgtaatactggcagtgatgggttttcttttattgctgattttagtaatttgagtctcttctctctttttcttgattgacctaagtaaacatttgccaattttgttatcttttcaaacatttaattttggtttattgattttctctgttgtttcatattccctttctgttggcttaactcttattatgaaattttttttgtctttaaaaattttatatttggttaattaaaatttaagttgattttggggtatcaacgcttctcttatatgaaaataagagcatgaatcaagaaataatgggttcccaaatactgcagtggaaacacatttttttgggggggtacaaaacaagtatccatgtacatatagtccttggttccccaagtcattgagtcaacttagtcaaaataagtagcctctcatttcttatctcatgagggtggtcttgccttgcttggagacattataatgaattcacttgatgtagttacttttaagcataccagtttacttcatatcccattttcaaccagttatcgtacccggaataattgctagaatcaaattccatcatgcacaggtaaataagtaaattctgtcatttactatctaaattagatatataattatttatagatacgtacatatattttacttgtaattcagtgaacataaggctttgtatgctctgtctaaaatatgctgtctatattaattctcatgatagtaaagaatagagtgatggagtctatattttacatatatcttccatttagtagcagaaataaaatccttgtacttgatttggtaaattcctccatttaaattaagatgttacttcccggaaacaaaatttttttttcttttttttttttaaattttaaatctttaatttctgttttcacatattttctttttgcttccaaaaggaaaggagtgcgtagctctgttgactgtgtacatcgtccacagcccctgggtcggggcagggtcccctaggccgcccgggggtccacatgcagcccctggggggccggcgcggggtgaggtccgggggccgccttattgctgaggtccggccggttggggcccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgtgagaagtcgatcacctcgtcctccatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgacgcgggcgcacccttcccaccagcgggcgtccccgggcccagctccggatgcgaccctccagtctccccactcagctaagtcagtgggtcagacccaggctccacaccagtcccgagggccacccccagcccccaacaccgcggcggtgggcgaagccagcggccccgccctattccctggcgctgccgttcactggcgtttcctagcaaggatctgcagggatcccgcctacagagtgcccctggggcaggggtaggggaggccctggcacctctcctcctcctggtcacccctaggtgcacactgggaactgtgtgccccctacattctgaatgcttcacgcctccctgcccgggttagaaagccgttcctggtgcactggccaggacagcagacactcttcctccctgcagcctttgcccacccccttggccatgaggaattcaggcagctgtgtccccaaatgtctccacccgattttggagtctcggagtccccacgcccaatgagatgccagtgcaacccaggtcagcatcgagggtggtggctgcggaggtggcaccccctcccaccagcaccttcccttgggagtggacaagtcctcggccacctcagcaccaccagctcccacccaggggcacccccacccccaggtcactggtgtgcggcccctgacccagctgatccagcaacagttacaaggcctcctcgtgcccaatcccaaccacgcgggacccacctgccaccctgcccatgccgggaccccacaactctcctcccacacgctccaggctctgatcccaggcagacgccctcttgcaaggcaggagcatgggcaggtgtgcatcccctctgcctggcattcggactccaccagcgggctgtccccgtccctggcctggaatcccagcctcctggcagcactccacagctcgccactcacccatgccccaaaggatgctgcctggctggtgcctgtggccccagctctgcctcggcctccccggcctgctccctggcagccatggtcagtagtgtgctgagccagcccagccctaccacctgctacagtcaggagcccccagctgccacctggatgtcaccactcaaaggaacgggacacatccccagtggaggccctgggcatgctctggcctccccctcacagctctgggcctaggttcctgcaggacaaagtggcagcaggacagatggccgagcagacagagctcagagctggccatggcgggtgtgactctgccagaggcccaggcagtagagacaggaggggccgaggaagtcgcatgaagtggtgattggtgtcagcgccccacactgctgggaggcccccggagccagggtggtgccaggggaccagctcccaggcccacagcagggaccgcctgcaatatcaccaaggcaacgaggaccccacctccccagggcctctgacttctcagagttgtgcctggtcccctgcgggagcaggtcagaccagtgggctggggagggccaggacgagacagccccagtggatggcgagcaggaaaggccaccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgcctccgcagatgggctcccagccacacgtgcacagacccccagaccaccacccactcccgactgccgggtggcatccacgcccctgtgataagctcagccccttcccgtcctcaggccaggggttcccagggagcctggctccacaggccagggtgtgggaggaccgcctggccacacctcagccatgtggaggcggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgcgcagggcctgccaggcggcgtcgatgtcggcatagaggttccactcggaaggcctgcccgcgctggcaccgtagccggagtagtcgtagatgatgttgcagtggaggcgggagttcagcccagtatagaagctgctcatctggcccaggtccaccgcgttgccgtgcgagaagaagaccgtgtacctggcaccaggcacgcagcgaacatacatgcaggagacgcggttgccgtgggcgctcttagtggggaagacctcgatggtgtccagctcgcgctggctgtactggaagtcggcgagctccgtcaggtgcagcttccagcgcccgaggaggcccgcagggtccccaagggggcggccccggccccaccaggccccggccccaccaggcccgggctcaggcaccagggagtaggtggcctccggcggcaggaaggcgagcttggcagcgatgcggccggggcagggcgggtagcagaaaaggcagcagagctcactcagcgacagcccgttcatggcaggcgcctcccgggccgggcctccaccggggcccccgccaacaacgccgcccggcctggccgggcaggggaggggtgggggtgctccgagtcgcgggcaggggtgagagccccagacggcagccccattaggaggccagggcccagccccatcgcggtccaagccgccccagggagcctcgcaaccacaggtctccatgtcgtgccgtgggaaggccaccccggcccgcgcccccgggccccagggccgcgctccatggctcccgaccgcccgcccgtgcatccgtcggtccctccgcgccccggcccggcctcctgcaccgccaccgccgcagctcccccacgaacggaagcaaaatttttcttaacgggatgataattcactagtttacctctaatgagtctcagtatttaatctatcatgaaattacgcggcaccaaaataaaatataattagttaaaacacaaaaattattttattgattaatttagacatcagatgtttacattatgaaatcaaggtattttttggtttttgttttgtttttagaatattagcaaatattaccaaacatgaaccatagtaaaagttcttcagtaacactttaccattccgttttcaaataacctgaatttatgtgccagattgaaaagcttttacatgagtgacctatatttctgtatgtatccaaatatttgtatatcatgtagacaagccaagaaaatacacagatatgtaagccattgcatagaatggtaaagaatacattcttaataagatgcattcgcttaatgctccaaacaggtctctagtatctcaaatgcagcattcacccactatttccaaacatatcagggccaggtgccatggctcatgcccataatcttggcactttgggaagttgaggtgggtggatcacttgaggccaagttccagaccagcctggccaacacggcaaaaccctgtctttactaaaactacaaaaaaaataaaaatagctagccatggtggcacactactataatcccagctactcaggagactgagatacaagaatcatgtgaacacgagaggcaggggatgcagtgagctgagccgagatcacgccactgcactccagcctgggcaacggagcgagtgagactctgtttcaaaaaaacaaaaccaaaagcattgtatcatgatatgtgactaagctgaatttaaaacactgtaacataaactagatgaaaagtattatacaaaatttttctttgtatttctatttgttttgaatttaccaacaattcaaatcttgctgagaatatttgcactataaatatttctgtgattattggttatattcaaattcgctcattttcaaagctacctgtataaaattattaaaattgtacatagcttggaataagagtatgttgaatataattgccatgtgatacatttatatttaataattaaaggcatattacaacacttacgcctcatcttaatgttacttaaccttagaaacagagtaaatgataggaataatatgggagacaaactgtggaaagccacattctgtatatctctgttgtttttattaaacttttttcctactgcactttaaatttgtcatagaccattattttagtaattattaatgtaatcttacgtatgtatattctctaccatcttagcaggttgaataaaatacatgattaaaggcaaaaatgtgtgcaaggaaaatatagaatatttaagttacaaaaagctactcttactgaatctcttaaattacagcttatagctaaagagtacaaactattgtaaaagttttctcccatttgtaagtaattacacatataaagtatctccccattcagtagatcttatatttctttgagaaacatatattaaatataaaatattctgaattctaaattgcatttaaaattgttcatcattggttatattatgtaattataagcaagtacatttaatgactacatactgtaaactttctttaccacgtggcacaaatagttaatttaccttttttttctgtctctgtcttctatgtcctaggctatttcagttttctcacgagtagccattattttcaatgaactaccaaaaagttataaggcagccacgatcaaacaaaaatgttagtaatatagtatagtataaaggttttttatttcttaatttatattccaaattgttaaataattttatcatccagtcttgatgtctgaaaacatcttaaaatagagaagttcacagtattagatgctgtatctttcttcatctaatgacaaaagactttagttcttttctcaattttaggagaagttttgctttaagaccaataaaaacataagtttacataagctgagagcacgttatgtatagctactctgtggaaaacattttattttaagagctattaggaacatcttttgagaatattcaagctatatatgatgctgcaaatttatttttatggttgctataactggcaaggcaagcagatgatatgcttgaagctatctcgtgatgagcacatctgagggaataaagaagggccttcacaagaagagggaggcagctggtacattcagtaatgcatcatgaacaccaatgcagtggctcctgagaaagagtcaatataatacctggattccttgtttctatctcatatgtaatccagtttcagggaagtataaaagtgacagggatggggagagtatatgaaccattaatatgaaatctaaagaagtgcaggcatccagctgtctggtgtctactgaggtcgttcacccagattaacaatacagatacttagttaaattctgaactgcagataatgggaaagtaggattgtggaaatcggctccatccaaattattactcaggtctcctcctcttccagatgctgtccccacagtatactcaaggtgtctgatgacagtgatgagcaactgaggaatcatttaattaccaagttcttcatccttacttaaaaatgtagagtcacaaaatcatatatgaaaacacactctttttttttttttttttgagatggagtctctgttaccaggctggagatactctttttcaatagagtatggccttctgtccactctcctcttattctttccagagtagcaaggtgtccttacggcatacatttagcataaaattagatgggttccattataaaataaaatggagacagaataagtcaatactgaattctttggtaaatcaagcaaagtctttaaaaatttttctagaaaatggatttatttttgtttttatttagtgtttgttttatttagttatttttagtttttttgtttgcttttgcttcattgttctgcattgctaactcgttaaaatcacaagctatcttattgtatattgagtgtatttgcaagagctgtttagtgttttcttccctagtgaaccaacataacgattattctgctatgagtctatgttacgaaatatgtctatgtcctgctattctcaggcttcatttttgcctctaaatccttcaggtactgttgttttgggcagtgtaatggatgtttcttcttttgttctttctgtgccttgaaaatttcagtaaggaaataaactggttgtcaaaaacacctgtttgttaaaattggaatcagactttttaaagaagagatatacttggtttccttggctaaatattcaaaagttaataggatttttttcatagtataacatagtttcaaaagttaaacgtaattgtatttagttttattgaatacctacttgtgtggcatattacatttatttttgttaatattaaatttaaacaattttaagtataaattattatatagtgtgcaaatgtctttttcatataatgacttctttttctctgggtatatacccagtggtgggattgtggatgaaatctatttatagatctttaaggaatctccatactgttttccatagtggttgtactagtttacattcccaccagcagtgtaaaaatgttccctttacaccatattcatgccaacatctgttgtttttttattttcttaattgtggctattcttgcaggagtaaggtggcatctcattgtggttttgatatgcatttccctgataattagtaatgttgagcatgttttcatttgtttcttggccatttgtgtatcttcttttcagaattgcctagtcataccctttgcccactttttgatgggatttgtttattcttgctgatttgtttgagttccatgtagattctggatattagtcctttgtcagatgaatagtatgcaaaatattttctcctaatctgtgggttgtctgtttactctgctgattatttctttttctgtgaagaggctttctagcttaatttggtcctagctacttatctttgtttttgttccatttgcttttgagttcttattcatgaagtctttgcctaagccaatgtctagaagagcttttctaatgttatattctagaagttttatggtttcagggcttagatttaagtctttcatccatcttgagttgatttttgtaaaaagtgagagatgaggatccagcttttttcttctacatgtggtttgcaaattatcctagcaccatttgttgaatagaatgtcctttccccactttgtatttgctctgtcaaaggtcagttgactgtaagtatttggttttatttctggttctctattctgttccatttgtctatgtgcctatttttataccagtaccatgctgttttggtaactctagccttgtagtatagtttgaagttgggtaatgtaatgcctctagattttttttttttttttttttgcttagttttactttggctttgagggcttttttttggttccatatgaattttagggttgttttttctagttctgtgaagagtaatgatggtattttgatgagaattgcattaaatttgtaggttgctttagtcagtatggtcattttcacaatattgattctactcatcgatgagcatgggaggtgtttgcacttgtttgtgttgtgtataatctctttcagcagtgtcccttagttttccttttagagatctttcatctccttggttaggtatacattcctaagtattttattttttgcagttgttgtaaaagaggttgagttcttgatttgattctcagcttggtcattggaggtgtataacagtgctacctctgatttgtgtacattgattttgtatcctgaaacttggctgaattcatgtattagatctaagaactttttggatgagtccttagggttttctaggtatacaatcatatcatcagtgaacagcagcagtttgacttcctctttacctatttgaatgccctttgtttctcttgtctgattgctctggctaaaatttccagtacaatgttgaatagaagaggtgaaagtggatatccttttcttgttccagttcttaggcgaaatgctgtagatttttctctgtttagtataatgttgactatggatttttcatagatggcttttattaccttgaggtatgtcccttctatgctttttctgatggttttaatcataaatggatgctggattttgtgaaatgggtttttttgcatcaattgaaatcatatttttaaatttttaattatttatatgtgattaattacatttattgacttgcatatgttaaaccatcccttcatccctgatatgaaacccacgtgatcatggtgtattatctttttgatataatgttggactcagctagtattttgttgaagatttttgcatctatgttcatcaggggctgaactatagacctacagagtctgaactattggtctatagttttctttttttgttatgttctttcctggttttggtattagggtgttactggcctcatagaatgatttaaggaggatttcctctttctttatcttttgaaatcatttcagtaagattggtaccaattcttcgaatgcctgatagaattcagctgttaatccatttggtcctggacatttttattgttggcaattttttttactattgtttcagtctcactgcttgttacttgtctgttcagtttctttctcttttttttttccacgtaggatctcgctctgtcgcccaggctggagtgcagtggcacaatctgagctcactgcaacctctgcctcccaggctcaagtgattctcttgcctcagcctcctgagtagatgggattacaggtgtgcaccaccacacccagctaattttttttattttcagtagagacagggttttaactctgttggccaggctggtctcaaactcctggcctcaagtgatctgcccacctcagtctcctaaagtgctgggattacaggtgtgagccactatacccagtgcagtttctatttatttgtgttttaatctaggagggttgtatatttccaggaatttatcactctctctaaattttctagtctgtgcacataagggtgttcatagtagccttgaatatatttcatatttctgtggtattggttgtaatatttcccatttcatttctaattgagcttatttggatcttctccctttttttcttagttaatctcactaatggtctattgattttgtttatctcttaaaagaatcagttttttgtttcatatatcttttgtatttttgtttcaattttatttaattctgatctttattatttcttttttcttctgggtttgggtttggttggttcttgtttctccagttctgtgaggtatgactttagattgtctattcatgctctttgatgtaggcatttaatgctatgaaccttcctcttaattttgctgtatcccagaggttttaataggctttgtcactattatccttcagttcaaacaattttttaaatgttgcataacaatgtttatttagttttacatttgtttacaatttcttataaacacttttcgttataattttatacaaacaacagtaggagaaacaaggagctagaaaacattagaaagttgagatttggagggaagaattttaaagactggaagtactagagggagagaatctagagaatgaaggaggcaatacttgaagagataacacaatgttccaaatttgttggtaaaacatgaattcgtaaattcaggaaacacaatatataccaaacatatatttaaataaaatccaggcctagactcaaggtagtagtaaatgacaagataccaaacacaagattttaaaagcaaccatggggagaaaaagatcatcaatgaaggcaagacagtcaaatcgtaggcttcgtaacagcaacagtgtacccaaacaattattttatttatttatttattttttgagatggagtctcgctgtgtcgcccaggctggagtgcagtggcgcaatcttggctcactgcaagatccgcctcccaggttcacgccattctcctgcctcagcctcccacctagctgggactacaggcacccgccaccacacctggctaatttttttttgtatttttggtagagacggggtttcatcgtgttagccaggatggtctcgatctcctgacctcgtgatccgcccgcctcggcctcccaaagtgctgggattatgggcgtgagccaccgcgcctggccatatttatacttttttaataccactaggctcaacccgtatgatattttttgcagcagctttcttgagatgtaattcacataccgcataaatcgcccatttaaaatgtacaaccgagcggtttttagcgtattcatagagtcgcacatcaccacaatcaattttagaacatttttatcaccccccaaagaaatccacatcctttagccgtcaacctccaatccttccatttctctgcacctaggcaatgtataatctactttctgtctgtatagatttgggtactccggatgtttcacgtaaatgcagtcatgcgacacgtgatcttgtggctggcttctttcacttagcgccatgttttctagtttcacccgttttcagcatgtgtccgtccttttccttcttttcaaaacagttttattgagatgccattcacataccatgcagttcattcatgtaaagcatctgtaattcaattgcctttagaatatgcacagttacgtagccatcaccacaatacattttagaacattggtatcacctcaaattcctttttattgccaaataatattccactgtatggatataccacgttgcatttatccactggtgggcattttcactcttagaatattataaataatgttgctatggatattcgtgcacgagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttttttgagacagagttttgctcttgttgcccaggctagagtgcaatggtgagaactgcagcctccacctccaggattcaagtaattctcctgcctcagcctcttgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcgtccggccccatgagcatctttaggcatcaatcttttatgcatctctggttatttctctagagcacattagtcaaatgattgtatcaaagggcacaggcagttttgaggctctcagtgcatgatgatatattgctttccaaaaaggctgtgcccgtttgcattctcaaaagtagagtgtgcacccctccttatattttaatagtttcctgaggtcatcagaacatgaacatggggagggcagggacttgcttgggcatcttggataccatgcccagttgaatgtgcagtacttagtaggggtttgtgtgacaggaatgagtgagagcacatgaaggcccagatgagtgcagggtccgtggggcacagaggagggtacaggtgtgtgagcaccgtgtggacttagcacacggctgacgtgaggactcagtgcagacacaagtggtaacaaggcctcgtgaatcaaagagctcctcaacctggaggtcgaagcagctgattggagatgaggaagccacactccaaggtcacttagggacagacgctggcagggctgatctgaagactggcagcaactcctttttatactccactctgcaagcgccagtctttatgcagagttctggaagaattcccttcactgagctagcaaggccatcaaactctgcgttcacctggatatcctaaggagacacccattacaaggatgaactttgttactatctgagaacttcaccatttttcactcacacacgcaaggtctcagagaagctccttcgggcggcttctcccctgtggatgacagtctcatacccgcaaactagtaagatccaggagagaaggggacaatgggggatgtttagaggcctgctgtatttatttatttagaaatgggatcgtactgtgtcaccaggctggagtgcagtggctcaatcgtagctctcttcatccctgagctcctggactcaagctatctatcctcttgcttaagcctccagaatagcagggactacaggtgcccaccaccatgcccggctatgctgtatttccagatctgggggctggttacatagacacctatgctgtttgtgaaaattctccaagctctatgcttaatctttgtgcatttttcagcatagatgttgttcctcaattaaaaacaaaaaaccaaggggttgtgaagaacagaactggcactgatggagtccttctctgtgcaaggcctttcccttaggtctgtcatctcagcttatgttcatgatggccttgcggggtagacgttagccccatttcacaaaaacacaagtctgagcccagggaaagattttccttgaactataagtcttcaaaactatttccctcaaagctcagaataaaatctgggctagtcagattatactagtgataacagataacaacagttaaggaatagaaggtagaatattcaattcaggctaattgtttttctttgtttttttgttttttgggtttttttgaggtagagtctcgctctgtcacccaggctggaatgcattggcatggtctcggctcactgaaacctccgctttctggttcaagcaattctcctgcctcagcctcccgagtagctgaggttacaggtgagcaccaccacatccagctaatttttcttctatcttttacaacacagagtttcactcttgttgctcaggctggagtgcaatggcacgatctcggctcactgcaacctctgcctctgggttctcctggaggtgattctcctgcctcagccccctgagtagctgggattacaagtgcataccactatgcccggctaatttttgtatttttagtagagacagggtttcaccatgttggccagactgatctcgaactcctgacctcaggtgatctgcctgcctcggcctcccgaagttctgggattacaggcatgagccaccaactccggccaaatttttgtattattagtaaagacaggttttgccatgttggccagggtggtcttgaactcctgacctcaggtgatccacctgccttggcctcccgaggtcctgggattataggcgtgaaccatcatgcccatcccaggctagttattgattgatcgtttatgattctttgactcagaatcttgtccaggatctcacactgatagacacaggatttggtcccaaccctgaactgattccaaagcccatggcattcccacgagactaggggcttctgataatgaccatacattgtgacaagtaagtgtatatttgggcaggataatgccatatgacattctatttcttttagaatgacagatccagtgctgacaggaattctcagagcagcaggcacatggttaaggcaagaacaggccattagaaggaaatggtaaggacgtttgacatcggttgtcccaaacctgaagaattgaaactacacagacacatttctggaaaggctttcactcaagtctgggttgaaaaaaatcagggttagaatcagcactgatttgtaactcaatttttttgtttccttccctttttttttgagatagaatctggccctgttccccaggttggagtgcagtggcacaatcatagctcactgaagccacaaactcctgggatcaggtgatcctcctgcttcagtcttctgagtacccgaaactacgggtatgtgccacatgcctggctaattttttaaaaagctttttgtagagatggggatcttgctgtgttgcccaggatggtcttgaactgtaggcttcaagggatcctcccacctcagcctcccaacatgctaagattataggtgtgagccatctcacctggcactttttctacattaaaaaatcaaaattcaccaggcgcaatggatcatgcctgtaatcccagcacttggaaggccgaggtgggtggatcacctgaggtcaggagttcgagaccagcctggccaacctggtgaaaccctatctctactaaaaaaaaatatcaaaaaaaaaaaaaaaatcagccgggcgtggtggcacacacctgtaatcctggctactcaggaggctgaggtagaagaattgcctgaatctgggagccggaagttgcagagagccaagatagcaccactgcactccagcctgggcgacagtgagactctgtctcaaaaaaaaaaaaaaaaaaaaaaatcaaaattgacccaagacatgagagaccatggcacaggatcacttgaggtcagaagtttgcaaccagcctgggcaacatagcaagcccccatctctaaaaactttagccaggtatggtgacctgtacctgtacttccagctgcttggggagcttagacaggagaaccacttgagccaaggaatttgagactgcagtgagctacgatcacaccactgcactgcaactgggtgacagagtgagaccctgactcaaaaaaaaagtggcaaaattgaatgaaaagggatcctaatctctctcacagccactcaagtgaagcttccagcaccacagtccacctgcagacagtcaggggaggggcagagggcagccttgcaggtgctgcgcctgcagatcgaaacctcagtggatagggagcatcatgcccagacctccacttatcctctctcagccaatgaagaacccaggcaggtgccccaggtgagatcccatggaaccagcagtctggagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttgagacagagttttgctcttgttgcccaggctagagtgcaatggtgagaactgcagcctccacctccaggattcaagtaattctcctgcctcagcctcctgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcatccagccccatgagcatctttaggcatcaatcttttatgcatctctggttatttctctagagcacattagtcaaatgattgtatcaaagggcacaggcagttttgaggctctcagtgcatgatgataaattgccttccaaaaaggctgtgcccgtttgcattctcaaaagtagagtgtacacccctccttatattttaatagtttcctgaggtcaccagaacatgaacatggggagggcagggacttgcttgggcatcttggataccatgcccagttcaatgtgcagtacttagtaggggtttgtgtgacaggaatgagtgagagcacatgaaggcccagatgagtgcagggtccgtggggcacagaggagggtacaggtgtgtgagcaccgtgaaggccagctccataggacttagcacacggctgacgtggggactcagtgcagacacaagtggtaacaaagcagaatggtgcagactgtggcaagttgagaacttatgcctctgtaaagggggcagccaccactcagttactgcagattactctatctttgctgaggacagttgcacaggtagtgcactgcagaagggtaacaccttagagggatgtcatttgcatcatagatgcaaaattcacaggcaaagactgatgtagtttgtccctaaagttttgctttgatttgcagatatttatccatggcagtttcgtgaaaaacgtctatagaaggttttgaggaatgggcaccttttaatttgctactaaactaaaccccaagggcccattatatgccagcgtggtcctagagattccacactcattcagttccttttcatcataggaagtgggcattataatatcaggtccactataagagctggaggctgggcatggtggctcatgcctgtaatcccagcactttgggaggcctacctgggcagatcgcgggagcccaagagtttgagaccaggctggacaacacggtgaaactctgcctttacaacacatacaaaaagtttagccgggcttggtggcatggccctatagtcccagctattcgggaggctgaggtgggaggatcgcttgagcctcggaggtcaaggctgcagtgagcccagattgcacaactatactccagcttaggccacagagcaagaccttgtctcaaaaaataaaataaaataataaaaagaaagaaagagaaaggaacagatcaataggtacaataaagtaatatttgtataaaaaaagcaaaagaacatatttatttatttggatatttgtttatattcataaactatctctagaaagataccaagaaattgaatctatttggttgtatctgagaaactgcaggaatagggacagggttgagatgatgccttctgaattttgaaatatacaaatgtattttctacttagaaataaatgggccgggcgtggtggctaggccgggtgcggtggctctcgcctgtaatcctggcactttgggaggccgagactggcagatcacttgaggtcaggagtttgagaccagccttgccaacatggtgaaactccgtctctactaaaaatatgaaaatggccaggtgcggtggctcacccttgtaatcccagcactttgggaggctgaggcgggcggatcacctgaggtcaggagttcaagaacagcgtgaccaacatggagaaaccccatctctactaaaaatataaaattagcctggtgtagtggcgcatgcctgtcatcccagccactcaggaggctgaggcaggagaattgcttgaacccgggaggtggaggttgtgctgagctgagattgcgccattgtactccagcctgggcaacaacagcgaaactttgtctcacaaaaagaaacaacaacaacaaccacaaacacacacaaaaattagctgggtgtggtggtgggtgcctataatcccagctactcaggaggctgaggcacgagaattgcttgaacctgagaggcggaggtcgcagtgagccaagatcaggccactgcactccagcctgggcaatagagcaagactcaatctctaaataaatatataaaataaataaataatattaagacaaaactcataaggacattacataaaccaagttatgccagtgatttttttaaaatatcaaaacaggcagttttatagaaaaatataacttcaggccaggtggggtggctaatgcttgtaatcccagcactttgggaggccgaggttggcagatcacctgacctcaggagttcgagaccagcctggcaagcatagtaaaaccccaactctactaaaaatacaaaaattagctgggtgtggtagaacatgcttgtaaccccagctacttgggaggctgaggcgggagaatcacttgaacctgggaggcggaggttgcagtgagccgagatcgcgtgactgcaacagagaaattctgtctcaaaagaaaaatataacttcataaaaacaaagtagggagaagcagaaaagtttgtctagatctagaaccattaaaggaattgaatgtttattttaaaatctgtatcccggccgggtgcggtggctcacgcctgtaatcccagcactctgggaggccgaggtgggcggatcacaaggtcaggagatcgagaccatcctggctaacacggtgaaaccccatctctactaaaaatacaaaaaattagccggccctggtggcgggtgcctgtagtcccagctactccagaggctgaggcaggagaacggcgtgaacccgggaggcggaggtggcagtgagccgaggtggtgccactgcactccagcctgggcaacagagcaagactccgtctcaaaaaaaaaaaaaaatctgtatcccatcccctcaaaaatctcacaaaaaaacaaaaccaaagaaaagcaccaggcccagatgattttatggacagcaaacattaaaaagaacataaagtttttatcttctacataatttttaaaaattaattatttatttttgacaggaagtctcgctttgtagcccaggctggagtgcagtggcgcgatctcggcacaccgcaacctccgcctcccgggttcaagtgattctcctgcctcagccacaccagtagctgggactacagccgcgtgccaccatgtctggttaatttttgtattttagtagagacagggtttcactatgttggccaggctggtctccaactcctgatctcgtgatccgcccgccccaatctcccaaagtgctgggatgtgtgagccgccacgcctggccactactttttcttttctttgtgtgtttttttttttttttttttttttttggtgtgtgtgtgtgtgagatggagtttccctcttgttgcccaggctagagtgcaatggtgcgatctcagttcactgcaatccccgcctcagcaggagagcaggaatcttcagtgatccactggcggatctgcagccattgtgcgcgccaggtcttcccaagtcttttgtgcgcgcgcctctccttccagtacctatcaagccagcgtcccctagcctcccgccattgccagcaggtgctgagatcgcgccattgcactccagcctgggagacaacagcgaaactccgtctcaaaattaaaaaaaaaaggatgaaaattttggaaaaatatggaagaaaccaaatggatttctagctcaactaaatcgtaattattcagtgtctagtttttgcaagaaaccatatatttcatgtccacaatcggccacagtcccagctctcaagtgtaggtctttcctaagcaaattgaagaacacaggcataaaagtgcattaagtcaataaacatttttctctgtgtctctctctctctttttttttttttttttttgagacggaggttcgcactgtcacccaggctggagtgcagtggtgagatctcgggtgactgcaagctccgcctcccgagttcacgccattctcctgcctcagcctccagagtagctgggactacaggcgcccgccaccacgcccggctaattttttgtagttttagtagagacggggtttcgctatgttggccaggctggtctccaactcctgacctcgtgatccacccgcctccgcctcccaaagtgccacagccccggcctttttttttttaagacagagtctcggccgggcgcggtggctcacgcctttaatcccagcactttgggaggccgaggcgggcggatcacgaggtcaggaggtcgaggccatcctggctaacacggtgaaaccccgtctctactaaaaatacaaaaaagcagccgggtgtggtggcgggcgcctgtagtccgagctactcccgaggctgaggcaggagaatggcgtgaacccggtaggcggagcttgcggtgagcccagagatcaggccactggaatccagcctgggcgacagagggagactccgtctcaaaaaaaaaaaaagaaaaaaaaaaaagactctgactctgttgcccaggttggagtgcagtggcgcgatctcggcgcatcgcaatcccttcccagcccccgggttcaagtgattctccagtctcagccgccggagtagctgggactacaggcgcgtgccaccatgtctgactaaatttgtatttttactagaaagggggtttcactatgttggccaggctggtctccaactcctgatctcgtgatccgtccgccccgacctcccaaagtgctaggattataggcataagccgccacgcccggccttttgtttttctttttcttttttttatttgaagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgcccgcctctctccttccagtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatccgtggtgtcaagacaactctaagaaggttttccgtgatcctgcaagccctgccttcctttctgggatcctgccttcaatttgattgcacaggtaccacagcaagccagtgctgtgtgctccgagttccagggcgtcctccagctcagccactgcactgagaacatggactctctgtggggcccaggagctgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatatgaccagtcatcccagacctcctggacgagctcgtgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcgggtcacacccagtgtgaaaaggtggcagagaaagcaccagggcagacactcgccctcaggaatgactcctccagatccgaggcctctaggcccagtacacgcaagtttcccctgctgccacacaggcgaggggagcctttgatgctgccacctcccgtagagctggggtaccgggtcactgctgaagacctggactgggagaaggaggcggcattccagtgcatcaagagtgcactgcaggttgaggacaaggccatctcagactgcagaccctcacggccttcccacactttgtcctcacttgcaacaggggcttctggtctgcctgccgtttctaaagcacccagtatggatgcacagcaggagagacacaagtcccaagactgcctgggcctagtggcccccctagcatctgctacagaggtcccctctacagctcccatgtctggggagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaaggcctggcacttctgctcctgcagctgccgcagcagcccctcccccctccacattgaaccgcacattggggtcactattggagtggatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctgaccctcagttcctcaaacacagtgagtgaggacggacctgaggctgtctcttcgggtcacacccagtgtgaaaagacggcagatacagcaccagggcagacactcggccccaggggtggctcccccagatcccagtcctctaggccccgtagacacaagtttcccctgctgccacgcaggcgaggggagcctttgatgctgccacctcccttagagctggggtactgggtcactgctgaagacctggaccgggagaaggaggcggcattccagcgcatcaacagtgcactgcaggttgaggacaaggccatctcggactgcagaccctcacggccttcccacactttgtcctcacttgctacaggggcttctggtctgcctgccatttctaaagcacccagtatggatgcacagcaggagagacacaagtcctaagactgtctgggcctagtggatcccccagcatctgctgcacaggtctgtagtcccagctactcgggaggctgaggcaggagaacggcataaacccgggaggcagagcttgcagtgagctgagatcgcgcgactgcactccagcctgggtgacagagcgagactccgtctcaaaaaaagaaaaagaaaaagaaaaaaaaagttcttgtgacatttctgtatgaaatcagccttcactacatggataggaccagcacgcttccgcggcacgactctgcaatcttactacattttttttattttgtattttatttattccttttgagacagtcttactctgtcacccaggctgaagtgcagccgagatctcggctcactgcaacctccacctcctgggttcaagcaattctcctgtctcagcctcccaagtagctgagactacaggcacacgtcaaaaggcccggctaatttttgtatttttagtagagatggagtttagccatattggtcaggctggtctcgaactcctgacctcaggtgattgacctgtcttagcctcccgaagtgctaggattacaggtgtaagtttatttatttatttaagatggaatcttgctctgtatttattaatttatttatttgagatggagtcttgctccatcgcccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcaggctcctgacctcatgaaccacctgcctcagcctcccaaagtgttgggattacaggcctaaggcaccatgttcggccatatttatttatttaattatttagagacaaagtcttgctctgtcacccaggctggagtgcagtggcgccatctcagctcactgcagcctctgcctccaaggtttaagcgattctcatgcctcagactcctgagtaactgggactacaggtactcaccaccacgcagggattttttttttctatttttttgtagagacacagtttcaccatattggccaggctggtctcgaactcctgaccttaggtgatctgacagcttcgtcctctcaaagtactgggattacaggcatgagccaccgagcccggcctctcactacatttaagtgatgccatggctcatgcctgtaatcctagcactttgggaggccaaggcaggtggatcacctgaggtcaggagtttgacacgagcctggccaacatggggaaaccccgtctctagtaaaaacacaaaaattagtcaggcatggtggtacaagcctgtaggcccagctacttggaaggctgaggcaggagaatcactttaaccgggaggcagaggttgcagtgagccaatatcatgccactgcactccagcttgggtgacagagtgagacaccatctcaaaaaaagaaaagaaaagaaaagaaaaacatatgatgccggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaaggatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacttgtaatcccaacctttgagaggccgaggcaggaggattgcttgaggccgggaattttgagaatagcctggacaacatagccagaccccatgtctacaaaataataagaaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaaattggcctgtgagcatgggtttgatcttcaaacaggacctggagggtagggacagacagtgctgtcacccttaggtgctgaacactcagaaacgggccagcggcagcccttccctcacctgcagacaccagattgggcagaacagcacgtggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccccaccctcgctgtgtcagggaaatgatcatggtggcggtgacactccgcaggcagggctgctgagagaagctgagaagggtcacactgcaggcagaggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgagggtaacctgtggcccagtgtatatggccgggtctcctcaagctgcattcattcaagtaggacccagggtgcgtgcccatctccagcccagggcagctcccctgtaagctgggtgagctactgaagccaaggcaggaggcagctgacaacacccacggcccatgcagaggtggtggaaaggctggagtcagcagcaacaccaaatcccggaccaggcagaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccgcaccccccaggccggccttccctgcagcctgggcttggccaccttggcctgattgagcactgaggcctcctgggcacccagccccatcactgcacctgctgcttccagccccaccccacaagctcaggggttcttcccagcggcgctgatcatgaagtcaacatgcacgcaagtcgtctcaggaaactttttaatgaaagtgttggccacggtggtgtgtaggtggctgagctcagattgcagctgctgagacaccagccacttaccaagagaaagccaggctgcttcaaacccagggcccgcggcaaaaaagcatcacttccggccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagagaagcacttttagaacatggaaaagtgtggtcatcccatcattagacagcacacatcctacataaataaaaagtcgtatggggaaggaggttggggagggaataaaaaactggcacagacattgatagactggtttccagtttcaaggtaacagatgcacatcatgagaccagaggaggcagagacaagggctggatttggcttttctaagcaacatgtgttcctgcgcagggctgaatggtcactgagacagagatggaagccaggacaggggagcccactgggcccagataggtacagagagcagaggctcctgttctgtcctcaccacccatgagggtgacactgcttgtaaatggtggctgtgctctcccagcaagaaaaaagcacaactaaatccacactgcacaaagacgcagacagaaagccttcaagtggctctgttttctgctccctgcctcatcaggtccacaagcagagaggagtgtcaggtacatatccctgctgtcaggctccccagtaagctgcgggctcagcaggagctgcccactgacacacaggggacacccactcctgccaccttgggagcggttgccagacagagccgtactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccacgttcatgggattatttcttgaaaatacttggcggcctccatgcttctgttttctttgagtcaggtagtcaggagggtttacaaacaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcgtagcctgggattccctccctggaggtcctgtcccccgacatttcacaggccttctgagctgctttccaaggaggactaacacggcaacaaaagaaccatttctgcacaaaaatcctggaaagaaaaagaagcaagccgagaatggagtcaaaacgctacccagtgctgactaagcctctcaaaccctgttctaagtggactgtggtttctaagtcagggaaatggaagaggccccacccacacagggacagggccacggcccccacaggatgaagcagcagcgtttattcaagatacaacagtgagggaatccggtcacgttcccttctccccagagagggcgcatcttgacaagtgatcgagtagaaatcttttaaactctaagttaagttcataaaaaccactggtttcactctgtctcccagggccaggcctggcctctgagatgcactggcttggggcgccctcaggtggctgcatggaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatagcctgattagccagaggtttccaggccatctgtccgcctccaggagatggactgggacctttagacatcggtggagaacaggatgctctgtcccttgctgtccggggcagggacggcctccagccgcaagaagtacagcagcacctcgacctgccctcgcggagtggggaagaggagagtggctcagaggggggctcacagctgctggtggggaggtctttggggcccaagtccccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccacaatgcctgcctaatttttctttgtattttttctagagatggggtttgctacatttcccagactggtctcaaacacctgggttcagttgtcctgcctcggcctcccaaagtgctgggattacaggcatgagccaccacacctgaacacttggggtggttttaagcccccagcaaggtgcaccagcaggagcaggaggtggcctaggctccccctatcactcccatccatgcaaacctaggcaagtccctgtctctgaatctcagccaccaccacatacaatgcaagttggaagatgggcaggactgggggtggggcaggcagaggccacctctgtcaggctggggttgcatgggctggagcctgtcttcccacacctgggacatgacctccaaggaccagctgtcagtcatggtgatgggctggccggggttggcagggagcttgctctccttctcggagggccggagcagcatggggccaaagacagtggcaaggttgtgcagggacatcttattgactgcctccttctctgccaccctgtagaggaccaaagcagaaggtgctgtttcaacgccaccaccaggagagaggcagaggggctgtgccgtgctagagtcctcagggagagagtgacctcgaccctggctatgagccaatgcgcccggcctctcactcttctttattcagcataatttattctgacgtatcttcagtgtaggtattctctttttattctcctattcctgttaaacccattgggctgaatgctgtttatttctagaatgtctacacctgtttttctgcaaggtcatttttttttctcgtttgctgttcgtcacatatactttcaagctcatcggttccctccgtgagtacaggtaagtggaggagcctcatggtctgcctcaggtctttgagatgttgagtctctggatctggtcctgctgctggccttttctgtccttgctcatggggcattgtttccgtgaatgtgtggttacttttgactgcattactcattgtcctggaaaaatgactttgtgggaatttttcagacctagggtaaagatgcttcctccaaactaggtttacgcttccttctgccaggtacctcagggcgctgtcagcctaaagccaatttaaactaaatccatcaactgtgaggttttggaatcttctcactggtgtgaatttgggccataagtcccaaattctgtggggtgctctgtggggtggggaccagccttagagttctcatcggaagcccggggtggctggatgggggcagatgttttcagggcaagagcggcttggctcgcctctctggtttctggtttccccagatggtgcctggcggctcctcactgtcttgtcagcccctggatgcctttaagaaaacatccttttattttgtcagcatttttggtacttctcagtgtgagggctggtccaagtatttggcttatcatagttttacaaaaagttggtttctatgaaatcttaagtcacctcttttttaaaaatgtaccttttagtccgggcacggtggctcactcctgtaatcccagcactttgggaagccggggcaggcagatcacttgaggccaggaatttgagaccagcctggacaacatggtgaaaccctgtctctactaaaactacaaaaatcagtcgggtgtagggccaggcgcaggggctcacgcctgtaatcccagcactttgggaggccaaagcaggtggatcacctcaggttgggagttcaagaccagcctgaccaacatggagaaaccccgtctctactaaaagtacaaaattagctgggcgtggtggcgcatgcttgtaatcccagctgctcatgaggctgagacaggagaatcacttgaacccgggaggtggaggttgtggtgagccaagatcatgcgattccccctgcctcagcctcccaagtaggtgggactacaggcaagcaccaccatacccggctaacttttttttggtatttttagtagagacaggattttaccatcttggccaagctggtcttgaactcctcacctcgtgatccacccacctcggcctcccaaagtgctggattacaggcgtgagctaccgcgcccagactaaaagcgcgcccggccgtctactacttcttatagggtgagaggcgggaggatcgcttgagccctgaagtttgcggctgctgcagttggctttgatcgtaccactgcactccagccagggtgacagcaggaccctgactctaaaaaaagaaaaagaaaaaaaagcatatactattaatacttcctccttactataatatttaccgtggcctttatcagactagagagtgcttttatctctcccttttgtaagaaagagcttttagaattatcaatagatggtcaggtgaggtggctcaggcctgtaattccagcactttgggaggccgaggtgggtggatcacgaggtcaggagttcaaaaccagcttggccaagatggtgaaaccctgtctctactaaaaatacaaaaaaattagctgggtgtggtggcgagtgcctgtaatgccagctactccggaggctggggcagagaattgcttgaacccagtaggcggaggttgcagtgagccaagattgtgccactgcactccagcctgggcaacagagtgagactctgtctcagaaaaaaaaaaaaaattattaatagatggtgaccctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggtgcgcggggaacgcccctctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcaggtacgtgcaggagatgggagggcctgtctcttggttcctctcggaagtcctgcccttgccctcgctctcattgcctccccgtccctgtctcccctgacactcgttcctccagaagcccggtaaaccccgtccttacgagccccgcccctagctcttctactacggaggggaactgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcggggatgtgggcggggcataatcgcctgggggcggggccctgagggctagatacgggcggagcgcggagggggcggggccatgaccagctggggcgttgcttacgactggtcctgaggacgtgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggtgagcagggcggtgggcgcggccgcggtcccccacgtgcccgcccgagccgccgcccacctgcccgcctttcgccctgcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaagctcgtgggttcgtcgtctgtctcccatgtcatgtaggagcttgactggcttttcagcctccaaagattccttcctttcttacagctcatggatttagatccactccccagtattgtaaacagcatttttagtttttcaggatacataatttgccatattgccagaaacttgtacatagcatttgacacttttttctttgccaatttgacaagctgcttttttcaagtattgtgatttgaaattatttctactatatttgaatttatttctaccatttgtaacatgttgatcctgatttttcaatgctcccctttccttctgtttgattatttgggaagtcacactctgtattctggtattcttactacttgagctcagctcattgctgtcatcttcccctaaaccgccttaaagcatcttaggtcttttccctctgatcacatgtgctactttttttttttttcttttcttttgagatggagtcttgctctgcgcccaggctggagtgcagtggcatgatctcggctcactgcaagctctgcctcccgggttccagcgattctcctgcctcagcctcccaagtagctgggacttcaggcgcctgccatcatgcccgtttaattttttgtatttttagtagagacagagtttcactgtgttagccaggatggtctcgatctcctgacctcgtgatccgcccaccttggcctccccaaagtgctgggattacaggcatgagccaccgtgcctggccaacattttctccagatatcttaccgagtcctaatttccactgcggacagagaatacactctgcgtgattttaattctatctcatttactgagacttgttttgtggcccagcacaaagcttgtaatgaacattgagaagaaagtgtattgttgctgttgacagagtgattttttttttgagacggagtctcgctctgtcgccaggctggagtatagtggtgtgcaatctcggctcactccaacctccacctcctgggttcaagtgattgtcctgcctcagcctcccgagtagctgggactacagatgcatgccaccatgcccagctaatttttgtatttttagcagagacagggtttcactgtgttggccaggatggtcttgatctcttgacattgtgatccgcctggcttggcctcccaaagtgctgggattacaggtatgagccaccgtgtcaggccgacagagtgtgttctaaatacccagcaggtcaaggtgagtgacaggcttgttcagggctcctgtgtttactttcttgttggtagcgccgtcaattgcttattgtgaaatgccccttcataaacacccatacacattttgattatggatggcccgtcttttttccatctgttattttcatcttagatctgtcttcatatgtaaagtgctttggttataatcagcacataactgggtctcacttcttcaattcatgtttataatccctgacttttaaattgggctggtaagtctattatgtttctccttttctgccttcttttggattagtatcttttaaaactccttttaacttatacgctgactcatattttttattaagacagtctcactctgtcattcagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtctttttcaactctggaaatcccattagaaattgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagagaggttgcagtgagcagagatcacgccactgcactccagcctgggcgacagagtgagactccgtctaaaaaaaaaagaaaaagttgactggagcttttcattcaactttttttttttttttttttgaccctgttacccaggctggactgcagcggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttcaaaatgagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattgtgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgccttctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggatgctgagctggcaagggcagaagagggttctggatccagagcctggctcctcctctccaccccacacagaccctacctgatgccttcatcccgctaaccagattaggaaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtaccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccttttgcactctgtccttgtcttccttcctgctgggaggcacagaagccatctggaggctgtgagggtggagacaaaggccacataagcccaggatggccaggagccgacgggagcccggggcggggctctgtctgctgcttccctctaagctgcccatggggtgaggactcctgggggacgaggcactagagcctgctttctgtttcctgcagaccgattagtcttatggaagcagacaagggagaaaaaaatgggggggaccccagaactgccatggacaagaagccatggaagagacacactcccacctatttgttacacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtgacagaccaggtggccagggagagccctggcaaggaggggatatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcaaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagagggcagcagctgggatgctgggacttgtcagatcctggataaacctcaaaggtgaaggtgatgggatgtgctgagagtcatctgtgggatgtgcataagagggagtcaaagacgtctgagcagacagaaggacctcgctggcatctacagtgaagggaagggccatgctggcatctacagtgaagggagggaccttgctggcatctacagtaaagggagggacctcgctggcatctacagtgaatggagggacctcgctggcatctacagtgaatggagggacctcgctggcatctacagtgaagggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctggggcatgccagtactgagaaggccctgagctcaagaaggtccctttattctggaggatgaaagggctacaaaaattacaaaggccttaagtccctgggaaaagcagttaggctcccagaacagctgctttcaagacccagaactctgaaggaggctgtgagcagctttccctaggctgatctgtcctcctaccatctggggcctgctagtgatatctgtactccaactgccctgcccccaggggtcaaccaacccactcctatctgaggacccactcctatctgaggaccagacagggaggccagaagttcaagggcacctggactaaggaagtggagaggagagaggtggatctgggctccagagccccaggtacaatgtgagggctgacacgtggtcaggagcacccccagtgccctatgaaatgggaacggctacagcccctactctttttcttttttttttttttgagacggagtttcgctcttgttgcccaggctggagtgcaatggtgcgatcttggctcaccgcaacctccgcctcctgggttcaagcgattctcctgcctcagcctcctaagtagctgggattacaggcacatgccaccacacctggctaattttgtatatttagtagagacagggtttctccatattggtcaggctggtctcgatctcccgacctcaggtgatccacccgcctcggcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggcttccagaagaccctgagaggagggcacacttgtcctcttctgggaagtggagagtcccaccaagagatagtgtgtaggcaggtgtgtgtaggcaggtgtgtgcaggcaggtgggcacctgggcccacacaggagtgagcgtggctaagacttcccaggatcgggtccctcctgagcccacaggaggacagcctcagggtgtgggggaaactgcaaccatcagcctagaccccaaggcctgggttcaatggacaggagagtaatatacatataatgccctgcttaagttgggcacacagcaggaccagagcaagttatcagttactagtgcagcccacatgcatttattttgggtcatgaattttaagtatcatacaaggatcatgaatctttcccctctcagtgaaatgaaggtcccagacccctgtaaggaggtcaggctccccactgttcccacgctgagatgcgaacagcaagtgtgacatctcttcatctcctgggcactatgggacctggacaggtcaggtccttgtggaggcagagacagggagtgaggacctgaatgaccacgtgctgctggggccagtgccaggtgtgagtgtgagtgggtggagaagcctgacacaggccaagggacctgaggccagctgagccactggagatggtaggagcaggaagtgcaagctggactccaaaagaccccaaatgaaacagtaatttggtttgtataaaaatccctttaagacacctttcccaattttgcttaaaataaaaaaaaaaggaagtggggtaaaaagcaggaagaacccatacttcctgccaagaccagctattgagtaggaggaggagccaccagacataagaaagacatctcggacaggcgcggtggctcacgcctgtaatcccagcacttggggaggccgaggcaggcggatcacaaggtcaggagatcgagaccatcctggctaacaaagtcaggagactcagtcacaaaaaaaaaaaaaaaaaaaagcaactggctgggcgcagtggctcacgcctaaaatcccaacactttgggaggccgaggcgggcggatcacaaggtcaggagatcgagaccatcctggctaacacagtgaaaccccgtctctactaaaaaatacaaaaaattagccgggcgtggtggcaggcgcctgtagtctcagctactcgggaggctgagacaggagaatggcgtgaacccgggaggcggagtgagccaagatcgggccactgcactccagcctgggtgacagagcgagactccatctcaaaaaaaaaaaacaaaaaaaagcaacaacaaaaaaagtcccagctactgggtcaggaggccgaggcagcagaatcacttgagctcaggaatttgacgtcagcctgggcaacatagcaagactgtcttcaggaaaaaaaaaaaaacaaaagaaaaaaaataaagacctccttctctctgggaaaatatacagcagtcctcctcaactgtcagttttatttaaatgtacaatgtccagtatagaaacaaaaactttcaaacattgaagaaaaaagataaaaagaaactgacccaagatgactcaaatacaagaacagaccagataacgatataaaaataattacaataaatatgctcaaagatttataagaaataatggaaagaatgcatgaaggtaagagaatctcagcagcagaaaatgcaaactataaaaaagaattaaatggctgggcgtggtggctcatgcctgtaatcccagcactttgggaggctgaggcaggtgcatcacctgcggtcaggagtccaagaccagcctggccaacatggtgaaaccctgtctgtacaaaaacacaaaaattagccaggcatgatggctggtgcctgtaatcccacttacttgggaggctgaggtgggagaatcacttgaacccacgaggcggaggttgcagtgagccaagattgtgccactgcactcctgcctgggcaacagagtgagaccccatctcaaaaaaaaaaaaaaaaaaaaaaaaagaattaactagaaatcctagatctggaattgtttctttttcttatttttaaattaaatatttattttttgttttgttttctagacctgagaattgtatctgaaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatactgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagtaaaatatgaaaacaggacacaaggaattagagggagaaattgggtgtcataatggcagtgggtatccacagtggcaatggtatacagctgtctctgcagaatcctctccctggcaagaactataactgatgtggccactccagttgtcatttactgacagctcactaggatgcaggtgctcttgtaatgatgtccaccatgcaggtgaggagccccgcccaggaatcagagccctgcaggctgaagcgtgacttccacaggcccttctgcatatctttgatgggagcaggctggtcaggctgagaacccagcactcccctgacttcacaggtgtccccctgactagacaacctcccccaggcgcccactggaccaaaatgtttcctaacagcgctcaatggtgtgattgatacaaaccccacgaggttataaaatagcaggcaaatgtgagatattatcatcactgccaccaccaccagcccggaacattttaattacatttttggaaatattccaattttcctgagggaagaagaaaatcaaaatccccctttttgaccactcatttcaactaatcctaagaaatacagaaagaaaacatgtcaaattccctgctaccctgacagttaacagaatctttgaaaaataaaattgttcttaagcgtttatctaatcagctgaaacgtgagtataaacttccttgtgggcaccccctgcagtagcaactccagaaatacggatgcagggaaagggggctgatcccaagattaggtcaagaaaaacattcccgtggacaaacacaactgctcccaatcaaattcaaagttaacaggtgttcaaaaagctggatttccaatttcagtagagaaatggctccccctaccgaggttttgggagataacggcttctaggcaccagtgggatgctgttaacatatattctattttctgtgactgtcaggtataataatagaatctgtaaggagactgaggcttgagaaggtgaggggcttgcccagtgtctccatgcttggtggtggcggcaccagggaaggctcttcccgtctgttatcccatcccatcctcactgccaacccgaggtcagggtcctaccggcacttccactccatccttgccagccagcagccactcccagcaggccagggccgtctccatgccatgctcattgaacatccggaggggaccccagcacagatgatgaaggagctgcgggtcacaatctggaaccaaacacacgtcagtcagaggcctccaacaacagctgaaccccaaaacagcttccctgggccaacaagagttgaccagctggggccagtgatggccttttattgactttccactcatgagagatactcctctactgggggagctcctgctctttctccggccagtactccagctggctatgggtcatcaaggccagcattcatttagaaacgagcccagaattccacagtgcttcagtgagttacctttactgctaatgagcattgcggtcagcttgaacatggcctgcgtgtagtgctgaggatgactgcggtctaaagctgaatgtagatcctggaccatcattttgttcaggtcagacatctggcctgtggtgcctgagaaccgaatcattccatacacctgcaaaaacattctcatcagcaactaagcatataatccaggcaatgtgggtaaggttctggaagccaccagaccacacttgtggtggcactggtgggtgcctcgctgccccaaagtggagctcatgcatgcagagagacaggctcatttcaatgatgctaccactgatcacagctttttttttttttaaagaacagctcctctagaaatgcatgttggcagtgccaccactgcagatgttccccaagggtgggaaccttgtccctcatcattgtacccagcagtgagcccggggtctgacccatggtgggactgcatgaatgtgagctggataaatacatttcctcaaactcaattaatgactcaaacaacaatatcagcctcattattattttttgagagagggagtctcgctctgatgctcaggttggagtgcagtggcgtgatctcgactcagtgcaacctccgcctcctgggttcaagtgatcctcccacctcagcctcccaagtagctggattacaggcatgcgccaccacgcctggctaatttttctattttagtagagacagggtttcaccatgttggccaggctggtcttgaactcctgacctcaaataatccgcccaccttggcctccctaagtgctgggattacaggcgtgagcggccacacccagccctccttactattattaataattttttctttgagacagagtcttgctctgttgcccaggctggagtgcagtggtgcgatcatagttcactgcatcctcgaactcctgggctcaggtgatcctcctgtctcagcctcccaaagtgctgggattactggcgtgagccactgtgcttggccaacctatctatttttaaagacaaatataacttttttttccagagagaagaacatacaagtgacagagtgctaagaaggagtgaactcccactcagaccaggccactgatagactttcagagtcaccagggagcttagaaatggcatagactaggctgggcgcggtggctcacgcctgtaatcccagcagtttgggaggccgaggcgggcagatcatgaggtcaggagatcaagaccgtcctggctaacacagtgaaaccccgtctccactaaaaatacaaaaaattagccgggcgtggtggtgggtgcctgtagtcccagctactcgggaggctgaggcaggagaatggcgtgaacccaggaggcagagcttgcagtgagccaagattgtgccactgcactccagcctgggcaacagaacgagactctgtctcaaaaacaaaaacaaaaacaaacaaacaaaaagaaatggtatagattagcttctgagtttatggagcaggaaatggaggcccacagatgtgatggcactggtgaggctggaataaactgtggtgtggtgggtgaaagcccacgatgtggagttggaagatgtggttccagaccccactccacttgtgcgactttggcaagttacttaatcttgggaacctccgtttatctataaaactggaataataatacatacatcttaccgagtgcccaagagcctatggcatgtaagtgtttgttactgctgtaaaaaaaagccaaaaaaattaaaaaccttcattcagtgtagccaaagtgtacacagagttaccctcttgtggaaaaaacaagtaactggtcattaacactctggaatgtgccaagaatcctcctaaaatgtgctctttaaatcctcctaaaatatgttaattccacatcaccgggacgctttgttcattttccactaggaagcggccaacaggcctcaaaacaagaggacacgttaaaggccctagggcgcaaggacaagagaagcacctcgcccgcgtagcggttgcgcagattcagggatgccatgaagttggagtagtctttcttcacacaggccgggcgctcgctcagctgagttgcctacagacagataaccattattgtagactatggcagcactatcctttcctcgtgtttaccatggctaagcctaaacccaatgaagcagtcacactcgggtctgggggttactattaataaaaatcttcactgctggcaagttaataaagcaaaatattttagaatacccagcagtttgatatgttccataagaaattaaaaaaaaaagtctctggaaggcagtttctgctactggtaaataggcctttgcaagaaaaagaatcactagattgtgagagcaatgtcacctgtgatggaaacgccatgaaagcattcacagccgtctccttgagagttgcgtgtgcagcttataaatgtcacttacagaccgtaaaggggctgaaggggagagccaaggccagcaggctcttaaacatctgctggctgctcttcagtctaatgggaagagacagaaaagggtacaccttgaatacaaaggcaacccacagaatgggagaaaaatatttgaaaactaccgcccacccactccacccctccagccactctctctgcttcagcctcagcctcccagccccagggcctcagtgacctggcttcctaacccaggctggctgctgtgccacacctttcagttcctgttcatccacggtcactgcagagtacagcatgcattgaaaaggacctcctttcgcatttccctttagcatcagtactaatggggaaagtgagcttctcaactgttttgagtttagagggatttttttttgaggggacatggtgtggagaaagaggaccaggagaagaaaatacagatgttggggaacatcaaaatataaacaagaacaaaaatacatgatttctctcatgaaattattaaactggtttatttaaaaaaataaattacgtgaaactgctttacattttctggaaacaatgcggtctttggcaccaagcaggactgagttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatcaaaaaaaaaaaaaaaaaaaagaatttttttttttttttttttgagatggagtcttgctctgttgcccaggctggagtgcagtggcgggatctcggctcactgcaagctccgcctcccgggttcacaccattctcctgcctcagcctcccaagtagctgggactacaggcgcctgccaccatgcccggctaattttttgtatttttagtagagacggggtttcaccgtgttggccaggatggtctcgatccactgacctcgtgatccgcccgccttggcctcccaaagtgctgggattacaggcatgagccaccgtgcctggccccagaattaatttttaaaaattaaaaaaaataacttagagaaaacctaacttacatcaaattttctggggaaaaagaacaaaatattttaggcaaaacagatctttcacaagtcagctggctagagtctagaaaaggcttacaaatgagaacacatattctattttatgtaataaagctttgctcctaccacccccaaaaaggaaaaggcttatgactatcataaacacttacagtctatgagttccgcctctggcctctgtggccacccagtggcagagacgtccaggtcagggcactgatacctggtgccccgtcagagtaggaggcccagggcgggtggccctgcaggtgcaggctggacccagctcaaccatgtctgctagactggtgtctttagagatagtgcagtgacctcgaggagagtgccctgatagcaaaatgaggcgagaagacaccagcattctctggcacatcctcaggccccacaaaagccagagggcactcaggcccctctctcccgccggtatcccaagggaggcctgtcacccttcctcctgggtacacagcctctgcacctccacatatcccatcccatgctccatttggagagagttgggaagcacacatggccaggctctagattcacattaaccaacaaaatctctgaccagccccagtcacatggccaggtggaactgcctgctttaatcctttttaactcttagctctaatttaactcagaaagtattgctgtgtgaaccctctgtcctctagattaatctctagcagaacaagaagctgaaggcattcatgtgcggttcagcacctgcagaaaacagaactgttcaggagtccagtatacgctccagataagtgcaactgtggcatcgcgctgcccgtgtcaggcggagctctgtttccatcctctcagatggggacattcaaatcaaaatctgatcactgacatatcaagcactgatccccataaatccataaatttaaaaaaaaaaaagcacaataaggaaacactcatttcaatggccacctcttctttgggccaaggtgcggcttgcaccactaccattgtcaacagacatccacagcaccctgcatgtactcatgtgcgtcatgaaaagcgacagccgagctctaagccttcccctgcactgtggctcctatggtctaaggggtcactgctcttcagaaggctcgcacataccccaagagttgtgttctgcttgttgtagccagcaaagtgaaggatgctctcagtggccatggccagccccgtgtgctgggacagtcccgatacccagttctgatgtttgttcagatattcctgaaataggaaaaacacatggggtttcagttatttatctgatttttttagaggcagggtctcgctctgtcacccaggctggagtgtggtggcacgatcatggctcattgcagcctcgacctcttagactcaagccatcctcccgcctcagcttcccaagtagctgggactataggggcacgccactatgcctggctaattttgcaattttttttgtagagatggtgtctcactatattgctcaggttggcttgaattcctgggctcaagtgatcctcccgcctcagcatcccaaaatgtcaggattacaggcatgagccactgtgcctggccttgctatttcatttaaaggggaaaataaaactttataaattaaggtgtgggcaaatggaccaaacactgggtttctgtcctgggtctgcccctccctaactagctgtgggactgtcagtaagtcaaagcccctctatgaccagctactgctcatttgactgaggacaaggccaattccccgagcggctgtcatgcagtcactgcggtgttgcaccgtcaatgggagagggccatttattctttcagcacatccttgctgagcatctgctgtggtagccaccaggcaaataagctacaaagccttggccttgcggtcaacaggcaggctgtgtggtgtggagcctcggttctctactgcagcataccagcagcctggtgtgggtgaactggacagcaggaacgaagaacaacacctgtgtccacctggccacccagtgggagaagggtgctgggcaatgggatacctggcagagcccaggggtgtgagggaggcctcctgctctggggaccacagggggctcagcctgcaggagtaccaaggacaagggtctcgagggtgggggcaagcctggaacagatgcaggccctgtttacaggcgtgaaccaactaattcccttaagaagaaatgtacaggagtatatacatgcagaattgtctcaatggttttgggggactcctggagctccagaaacccatccttggacactatgacgatgaagagtgactaataatcaagtttaaaagggaagtacactgaccagataccctattaaaaccagactactctggtgggtggaggagagggcagattcggggaaggctgaggctgggcacggagggtggggaataagcacactgcaggggaagtgaaagggcaggcctggggcacgccaaggggacacctggtggaaaaatcaagaccgcttcaagccttttcattttccatttccttcttaggccagacctgcgtgagaaagtaaaaagctctatcagctgctttttttgtccacttaaactttctaggcattagagggggcctcccctcttcagacgacagacagccttgggacctgaggcccttttgctgtaaatgaacaaagggaaatagtttcttgccactgcgtttccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcccttcctctcgtgagcagcccccaagtcttgccacagacctggcacctcacctggtgtgagccgtcagatgccctccttgtgccctggccagcactggccccacaggcgctcctaacacacagagcagcctctgaggcatctattattctcaggccctagactgatgcttccagtctccattcacactagtgctatttggattttgagttcttcatgtctctgtaaagcttttttgggagtttgaaggagcttatggcaattgccttttgatggtttcaagtacctgcaggtgggacttggtgacggtaggtgcccacttcatggcctcctggaggatcatcccacagcgtgcagcgaagtccttcacaatgctctggaagagggtgaagctgcttctcaacaacccgaggtcagttcatctgagctgccgtagtgactgtcatgggctgaactatgtctccccaaatccctatgctgcgccttaactggtaccagtacctcagagtggaactcatttggagatagggctttaaagaggtgattcaattaaaaggctgatagggtaggtcctgatccaatctggccagtatccttccttacgtgtgtgcagaggaaatctggacacacagaaatactggggcagggaggagggtgtgcacagagggaagaacacgtaaagacacagggagaaggctgccattcacaagccaaggagagaggtctccacagaaaccagctctgccaacactttgattttacacttcggccctcagaactgtaagacaatcaatgtctgtcaagacctttcaagctgcccagtctattgtcttttgctacagaagcccaagagactagcacagccactaagtttgaacctcaaggcccctggggccaggaagcccacacacactatgatctgtatgtaattcctgcacaaggtttgtggcagaatctacaagaataacatgtcacagggacactgtgcaacttgtgtcctgggtctgggactggatggaagggcaggctctgcgtggcaaaatcctcttcggtgccacaccactctgtgggaaactccccattgacagctggtctggcagaggtccagaggtaggacatgactcagcccaggctgaaggagctgtgagctgagttgcagtcttgccacagtgagggctctgagaccgagttggggagaggagagacccagtacatcctcctcttttggagtgatttattctgccagtttccccattggatagcacaagtcaaaggcatgatcccctattaccacaataacaaaatgtcagtgcacctcagagaagtgaagtccacctgaaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagccagctccccttgcactcggtggagcctggcaatggcttggtctcctcactgggggatggggccagcaccacccacacctcaaattgctggggactgggtgagctcatgcaggttgaccatctcgtggaaatactcagggaattgtggtaaagatggcccttagtgcaggggatcgtgtcgggcctacctcacgggcttcgtacgtgtcaggaaccgtgatccggtagggggcgtcggggatgtcatagtaaggctgatccttgtgaatatcctgcaagcacagcaagactccctcttccaaactgccttccccaagttgccactagcaaccacatgggccacccctacccaccacctgtctgtctgtgacaggcctccatacttgatgcaacttattgcaaaacaccaggtggatttgggccccctcacccccaactcgacacctgtagcattaattatgttcaggcttattgtcagagaagcatgccacaacacagggcggacagggccggcggggtggtggtagagcgggtggtgtttgggccctaggtctcctggggacactcacagcgctcagtgacagtgacagggtctgcaggatgtccagcatggtcttcagcacagtcccgctccagagcaagtggggaaacctgcaccaagagccagctctcaggaccaagagccaaacctccaaggaaggtctgcttctaggagccccctcagctgccagcccgagcccatatctgcttcaggccagctgaaggaggaggtcgggaggcccttgcagcaggatgcctggcctcctcaggctcattgcagtaaggtgagcaacgcctggtcagaaaggctccccaggcccctgccagccccacttcttagggccagacaaacctgacaccaactgccttggttatgcactggccaggacacccctcactttccaaagcaatcctcttagtttctgaccagggttctccattatttctcacataatggagaaaacaacagtatctacctgacaccctggggtaagacaggccatgggctccgatggccccagggctgaaggagaggtgtctctgcacagctgtgacccaccagtggcccactgctcaggaagcccagctcagacacacgccacgtgtgtgctggactcgttctcgtgacccctggctggctcctgaccacctgtggtggcgctgctgcctggaccaggcacacagtatctgcaacaggctccagaaccactggatacctctggggagctgcaggcagcctccatgtgggtgttttgctgcctctggccttctcaccttggagaagctggtccagcccacctgtgagagttctcatcagtgtggggacatgtcccaacagggtctgttttggctcccagaacaaagagtatacagcacagaagggtctgtgtgggcttttgttcctgagaagcccaaagatactgatcctaccaggggacctctggctgggccctgggctagaagatggtgcaccaggtcatgccagagtgggtgggactgagagacacagggatgtggcacccagcaaatgtgctgtaagtaacatcgatagctcagaatgaacagaagtttctgcaccaaaattcagactctgcaggaaactcacagacattggagggaggctgcatcacccttaggagttttcattctgactccattttttcctagattaataatataaggatgatttttcccagcatttgaaatcacagaagtttatatacatacacacaaaacattagcaggaaaatgagcttacttatccaccagaccagatagatacttgtctgccaccctccttatcctcttgtggatgtggttgaagttcaccaacaggaactgagcgtgccgctccagctcctcctcgttctccttggtcttggcctagagatgcaaaagaaacaggtaccgcagtgccccagatgcctccagcagacagacacgcattcatgctggagaggcttactttatccgccatcatgttcaggaaggcatcgaatactttgtccgcgactgcaatcacacactgcatcatccctgaaacgagaaggtttccatggataaggtgcagcaacagagagagaatcctagcaactttcaatcattttcttttgaaatgattttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggagaactccatagagtggatgtgccctttcttttttctttctcttttttttgagattgaatctcgttctgttgcccaggctggagtgtggtggcgcgatcttggctcactgcaacctccgcctcctgggttcacgccattctcctgcctcagcctcctgagcagctgagactacaggtgcccaccaccacgcccggctaattttttgtatttttagtagagacagggtttcaccacgttggccaggatggtcttgatctcctgacatcgtgatccgcccgcctcggcctcccaaagtgctgggattacaggcgtgagccaccgtgtccggcctggatgtgctctttctgcatcacgtaagtggtatgtgataacagtatctcttattactggtgaagctaaccttgatcccttggtttgagttaccgtttttccctttttctattttttttgagacagggtctcactttgttgcccagtctggagtgcaatggtgagatcatagctcagctgcaaccttgatctcccaggctcaagggatcctcccacctcagcctccctggtggctgggattacagatgtacaacaccatgctcagctaattgattattttttgtagagactgggagtctcactatgtagcccaggctggtcttgaactcctgggtcaagcaatccttctgcctcggcctcctaaagtgctaggattacaggcgtgagccactatgcccagtccctttctctattctttagaagcaagtcactaaggacagcccacactcagagccaaggaattaaatgctacctcctgaaggaaatttgtgaatgagaattacagccaccacagcgattgatattttggggaagatactttgaagttatgcagagatcatgtcttttaagattttgccccttcactttggcatccacgagtgaattctgcctgcagtagttactgtggttgtcataggaattttctatttccctcaattctttctactttttaaaaaatgttggccaggcatggtggctcacgcccataatcccagcactttgagaggccgaggtgggtggatcacgaggtcaggagttcgagaccagcctggccaacatggtgaaaccccatctttactaaaaatacaaaaattagccaggcatggtagcgtgccactgtaatcccagctacttgggaggctgaggcaggagaatcgcttgaccccaggagacagaggttgcagtgagctgagatcatgccactgcactccagcctgggtgacagagcgagactccatctcaaacaaaacaaaaatttattttttagggacagggtatcgctttgttgcctaggctggtcttgaactcctgggctcaagcaatcctcctgccttggcctcccaaaatgctaggattacaggcatgagccaccgtgcccagcctcttctatttttattaatagtaactggaattctgtaaggaaggttcagcctttttccccattttttatttattcggtagtctaatcattacagaaccgtggatgtttattcgttgggttataatccaataccatttattctattcaaatcattccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttgagaccagcctggccaacatggtgaaaccccgtctctactaaaaatacaaaaattagctgggcacggtggtgcacacctgttaattccagctacttgggaggctggggcatgagaatcacttgagcctgggaggtagaggttgcagggagctgagattgtgccactgcactctaggctgggtgacagagcgacacactgtcacataaaaaaaaaaaaaagaaaagaaaaagaaaaaaagcaacagaacacagtgatcatcacagtgcagatgaagaaactgtaataaaatgccaattcacactccataatgctgtttctctatccagtgtttttaatttgcatgactacatgctgggtctgccctctgcctccaggcagagagacaaggcaggtgctatcagcttggcacctcacacccagcatgaagcctgagacataaagaggcctttcatagctatctgttataagggtaagtgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaattttttgagacagagtttcgctcatcgcccaggctggagcgcagtggtgcgatctcagctcactgcaacctccgacgggttgcattcccagattcaagcaattctcctgtctcagcctcccgagtaggtgggattacaggcatgcgccaccatgcagggctaattttgtattttcagtagagatggggtttctccgtgttggtcaggctggtctcaaactcctgatctcaaatgatccacccgccttggcctcccaaagtgctgggattacaggcgtgagccaccacacctggcctagtataatagttttttcatatagttctttggaaactgaaactgtaaattcctgataatcagatagacatcagatgccaatcaatgtcatgtagtagcatctaaggagattaaaaaaaattttttttttgagacgtagtcttgctctgttgcccaggctggagcgcagtggtgtgatcttggctcactccaacctctgcctcccaggttcaagtgattctcctgcctcagcttcccaagtagctgggattacagtcacctgccatcacacccagctaatttttgtatttttagtagagatgggtttcatcatgttggccaggctggtctcaaactcctgacctcaagtgatctgcccacctcggctcccaaagtgctgagattacaggtgtgagctaccacacccggccctaaggtaagtaagatttttactttaaaaaggccactctcctcttaaccccttagtttagctctggattactggtgaactgactcacaggatggtgggcaggtgagcagcaggctcctgccctcacgttcctgtgcagctgagaacataacagaggctcatcttatacctgcagagaggaggcagaagtccccactttagtggggctgctagatatttcatataccctctcctcctggtaggttctgaaaattcaagaataatatatgtctccaaagacatttccttcttatctttcatgttttagaggaaaaatataagagggatatacactcaatagctgtacatttactggctaagtgccacgctcagaacaaaaataatcagtttgaaaccatgtggaagagtacaatgtactgcaaaaatgaaaatcgctttattttgaattaaggtgaggaggaacaatcagtcccccggaacaatttaacgtcctctgatgtcacaggaacagaaaaacagagctcagagagaagggcgaatgagacatctcacttcagaaagggatctgattcggtttatgaatattctctagaaggctggcaaaatctgctaggttctccttcctttttttttttgagatggagtttcactctgtctcccaggctggagtgtgtggtgtgatctcagctcactgcaacctctgcctcccaggttcaagtgattctcctgccttggcctcccaagtagccaggactacaggcacacgccaccgcacctggctaatttttgtatttttagtagagatggggtttcatcatgttggccaggctggtctcgaactcctgacatcaagtgatccacccacttcagcctcccagagtgctgggattacaggcgtgagctaccgcacccagcctttttcttcctttttttgtctcctcaggtcttgtctgaataatgtgctaggtgcttaattcttctagaggttggcagtttcaattttgttgttgcttagtctctctcctagaaccaaagaatcgcagggtgggccaattgtctagcacaagcttttccaatctgcagtccacacacagcccaggatggctttcaatgtggcccaacacaaatttgtaaacttaaacattatgagattctgggccgggcgcagtggctcatgcctgtaatccctgcactttgggaggccgaggcgggcggatcacgaggtcaggagatcgagaccattctggctaacacagtgaaaccccgtctctactaaaaatacaaaaaattagccaggcgtggtggtgggcgcctgtagtcccagctacttgggaggctgaggcaggagaatggcatgaacctgggaggcggagcttgcagtcagctgagatcgttccactgcactccagcttgggcaacagagcaagactctgtctcaaaaaaaaaaaaaaaaaaaaaaaaacatgagattctgtgtcttaaatgtcttaaaatattataagattttttgtgtgtgatttttctttcttttcttttttttttttttttttgctcattagctatcgttagtgttagtatgttttatgtgtggcccaagacaattctttttcttccaatgtggctcaaggaagccaaaaaattggacacccctggtctagcacaaaacttagcacaaaatctgctactacatggacaaatgcaaggtggacggatgaggggaacagatcaatgaacagttcagccagagcttgacagcatctctcttatagccccaactggtcctggggcatgtgtgtgagactctctgaatgtggcccccaccccgccctgtgtctacatcccctctggaagaggcttctctgtagaaactgcctgcctgcacctcccatccctggcctcaaatgggctccttgctcactccaatcccctccttactgccagaagggggagcttccagaaccctcacagtctttccttgccaactccactggctcccagctgcaaaaataaattcatgcacctgacttcctgactgttgtacagcagtgtgaagtgctccacaaaggacttactagaagagtcttacctgaagcagtatctcagagcccctggggcatttttttgtttgtttgttttttaagagacagggtcttgctccgtcacctaggctggagtgcagtggtgcgatcctggctcacttcaaccttgaactgggctcaagggatccccctgcctcagcccccagactagctaggacgacaggcatgttccaccatgcccagctaattatattttttgtacagatggggtattgctatgtagcccaggctggtcttaaactcctggcctcaagtaatccacttgggttggcctcccaaagtattgggattacaggcgtaagccactgcacctggcctggggtgatttttaaaaaacatttcttgaagcgttgatttttctttttcttttcttttctttttttttttttttttttttgagacagagtctctctgtcacccaggatggagtgctgaggcacgatctcggctcacctcaacctccgtctcccaggttcaagcaattctcctgcctcagcctccccagcagctgggactacaggcgtgcaccaccacgctcggcttatttatttatttttgagacagagtctcactctgtcaccaaggctggagtacagttgcgtgaactccactcactgcaagctccacctcccgggttcatgccattctcctgtctcagcctcccgagtagctgggactacaggcgcaggccaccacgcccggctaattttttgtatttttagtagagacagggtttcaccgtgttagccaggacggtcttgatctcctgaccttgtgatctgcctgcctcggcctctcaaagtgctgggattacaagtgtgagtcaccgcacccagccaatttttttatttttagtagagacggggtttcaccatgttggccaggctggtctcaaactcctgacctcaggtgatctacctgcctcagcttcccaaagtgctgggattacagctgtgagccactgtgcccagcctgatttttcaacaaaagaaaaaatggtacaagaagtatcggaaataatttctccataagcaagaacaagttgatagattcaccaacctatcaaaggcttctggtgcggaaaggactacacactgttagttgtacttcattaatactaaatttgtcaatctcaagaatttatcaataagcatgcctcaaagaatttattcatacagttaatcaaaatttgtggattctccccaattcccttgcatatttaaacatgatttcatcataattacaaaaattatcaaattattctaagcatttaattaaaacttaggtctaacatttcagcatattttaaatttttgattttaaacaccttataaatcagacttcttagtgcccttacactaaaactggccaaaaagtgcttatacgcagcatttaactttttcctttgttgtctctattttaatatctttttattggctaaatacacttttgtaaaactaatattagccttttgcaatttaaaaaaattaaggtataatttgcatataataaaatccacaggtcttatgtgctcaattccatgacttaacaactgtacacactcacgggaccactacccaaacaatctagaggacacttccatcaatccagagggtctcctggtaaccttcccagtttccatctctcctttttattcttatcttagctttgtcttcatagggttttgatcattgtaacatttttatgccttcctacagtttccaccatttctctgtcttcccaggagttggtctcctgggctagggctggtaacagctgaggccctctgtgcactcagggtctgacgacaagttgcatctggaagcaagtggcatgatcatagctcactgcaatcttgaactcctgggctcaagcgatcctcccactcagcctcccaagtaacttgggactacaggcacaaactactgtttcctgctcctgacgtttaaaaaccatgactgctctctggcaacagcaagttgctgcaggtccatcagtgcccatccgaggagccctggtccctctagatgagtgctggagcacacttgagcatagatagtgggctagaatgaccatccttctgttcggggcccttgcaccagcagtagaaccattaaggcgtatatttgaaggctatatgttttatactgatctttctcatgcaatatttaacttcataaaacattttctacatgtagacagaaaagaggaagtagtacgcctttttaccctattaaagctcaattcatcatgaaagcaccataataatgagcttaccagatttgtctttctgaatagctttatcctcaaagtagcagaacattacctggaagcgatcaggatctgttgaacgcagtaccctaagaagaaaacagctttaaataaattttgaaaaatctgggccctccctatcacagatttgacactgcccataagtggtaaggatgtgaagaacatttgccctctgtcattcataagggtgcacactgaggtggactttttggagggtgaggtgcaccatctattatacattcccatatttttcactccagcagccccaccattaggatatatcttcagggttacatgcacaaggattctcctaacagcactgactgcattatccaaaatggaaagactctgaatgctcaccaacaggagactgggcagataagccaaagcatacccattcgatgacacatcatgcagccaccaaacgagaggcagctctctatgtgagctgttacaaaaaaagtctgagacatactattaacagaaaaaaggaaggtgcagggaacacatgtccagcatgaccccacttacaggtttcctaaaggtctgtctttgcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaaaaaatatctttaacctcagggggaaagggagaaaaaggaaaaagcgcatgcacttgtcccatgggtgctgtgaagggctgttcagagttccaggggctccactaaggcagcagcggctcggcaggccatgtcttttggcctctgcaccaacctgtcaagagttaagcctcaggagggcaggccaggtgactttcagcacacgcattcgagtgtgcacgtgcacacacctttaacttgatttcccaaattctccactttgtggttttaaagctctctcaatacccagtggctgggaacctgagccaggttcctgaataaaggctttgaggttgcctctctatgctaacagagtgctctcaagggcctggtaggcagcccgaggtggaaggtgggctcacaggagctgctatgggctgcgtcttagagtcttcctctgccagttaagagcccgtcctgagaacctgagaaaactactcaggggcatactcatgggaaaggcagaggtagctctgccttcaaaccacatgaggttgagagggtctggagatacctcttctagccgtacatgctgggatgaaagccatgtttttgctctgtttgggtctggcttgttttgttttggctgttttttctttgaaaatacattgtttagaaaaaagactacaaacagctatactaacaggctataggggatgacagtgaggtcagtgttttttctctctctacttattttgcaagattttgtataaatgttttgtttttataagacagggtcttttgcccaggctagagtgcagtggtttgatcatagctcactgcagcctcaacctcctaggcttaagcaacccccttgcctcagtctcctgagtagctgggactacaggcatgtgccaccacaactggctaggtttttttgcttttttttttggggggggggggggttagagacaagttcttgctctgttgcagaagctcaaaacttccgggctcaagtgatcctcccacccctcaaaatgctgggattagccatttgtttttttgagacagagtctcactctgtcgcccaggctgcagtgcagtggcaccatcttggctcactgcaacctccacctcctgggtcaagcaattctcctgcctcagcctcctcagtagctgggactacaggcatgcaccaccacatccagctaatttttatatttttagtagagacggggtttcaccatgttggtcagactggtctcgaactcctgacctcaggatctgcctgcctcggcctcccaaagtgttgggatgacaggagtgagccactgcaaccggccgtgcctagccatttttgtgcaatgttctttttttctttttttttttttgagacggagtctcgctctgtcgcccaggctggagtgcagtggcgcgatctcagctcactacaagctccacctcctgggttcatgccattctcctgcctcagcctcctgagtagctgggactataggcacccgccaccacatctggctaatttttgtatttttagtagagatggggtttcaccacgttggccaggctggtctcgaactactggcctcaggtgatccactcgccttggcctcctaaagtgctggggttacaggtgtgagccaccacatccagccaaaataaaagacacttacaatgaaaaaagaacaaagtcaacactcccttggctctgtgggacttggggagaatgcgtcactgatttccacatttggctgtgtgtggagccccgggctgagggcagggaggaggagactgagcaggagggtagggtgcattcccatgcaaccaaagcactctgcctttcttttatgtattgagctttcaaggactattttactagagggttggtggcaacaatgaaaggctaaaatagtgttttccaaatagcctttctctcaggaacactttctttttcaaatcatttgggaaagaaattattctacgacttatttgcatccctcccgacttaagctgagtgtaatttgaccttttcttgacaacaggaatcatcattttgtagccaatgtactcagctgctgtcccagggcgcctgaggcctcagcacagtgggtctgtatagcactgcctacctcacaagcatgtcggggagtgcgtaaacatgtgtaatgcagcacagtacctggtacagcacagacactcaatccaagcttacttctgaggtcaacatgataacagctgtagatcctaagtgtcactaccactgttaggactgctgtggccacagatgtgtcctgagcatcgggccacatgcaggactgttttggagccggccccaccccatgtcgcatttgctgtttgtactcaaccatggtcctgggaaacagctcagtgagtgtcctagacacgcactcagcgaggctgggtcctcagaagggcctcgctcagtccgtgggctgagttcacaacactgactgcaactgctcagaagcctgtttcctatcagagagaagatgatgcggagcttagatactgggaggtgttactatacgtggtgtctggtggtcatgaaggaggggcatacgagaaaagtagagggtgtttttgcttggtttttcagaaagtttgcatgtcttgggagaagttgaaaaaagtctcatgcttacgagggcacaaaaatgaaaaccctgctcaaatgtggatgtgcatgtgcatggtggtgaaggcacgtgtacctcatgtactccagccggtacacagagaggaggtaggtggacatggcgaagtccagcttgttgatgagtgcggacacctcgggaggggggtccagcaggttgatgatagtgctgcggagctcactcagctcagcctggagggagagaaacatccgagggctcatggggcatcccccaggacaaacaggtcccagtggctggcaacatgtgttaataatgacagtgaaaagatctgccctaattggcacagagagcatggtaaaaatgagatgtgaatccttacgggggtgaccgtgtcattcttcatggctgagttatactggaggacggaccgcagtggctccttgctgggaaaggtgagcaagggggacttagtggctatttcacagaccccctcgtaccattcttctggccagagtcctgcaataaagtgaacataaatgaggaaatcaccttggtcggaaagcactgcagtgaggttgactgacaatttctatagtcatgggtcctttgagacaattatcccaaaaactaggcacagaaacgaagtctgttacctgacttggacagacttttcctaaggtgtatggcattctcagcaccctaaactacatctggggacagtaacacttgctaatacttgcagaaagaagcagctgcatgtggactcatttaaacatgctcacattcataattacgtgggctctgacctcacctttaccttcactctgcactccgtcttcactgggagagagatgatccccctacctgagccctccacagcgaatcccatcagaacggaatacagccagaagtctcggaagagcttctgtaaccgaggcttagcttctttgatgggtggcagtcgtcgggtgagctgatgtgccaagaagagagggagaaaggaggttatttgctgaggaaaccctaagccctgtaggtgtaaaatcaaccacagattcattctctaagagcattctcagaaactcagactgggtaggaaaaggcacactgagcagtgatgattctgccaataagcattgtccatccactcatttactgagtccctagtgtgcaccaggtgctgtgccagggaggaaaaagccctgttcctgcacttgaaggacttcctgtctagtttggaggcaggtgagcaacagttacagtggggtggagttcccagagaaagtgtcatgggtctcagagttaacatttgaggaaaacttagccaggaaagaagagaaggcagcctgtccagccacaagagcattaggtcctaagcctggcactgtggagggtaacaaatgctcaggaaaggcaaacaatggatgcgagccagagcttgaggaagggatgccactggggaggcagggagagcacaagaactctcatgggccaggcagcacaaattttccaaacagtaatcttcggcagaatccccatatatgtaacaggtaaagcagagttgcttgggtgcaggtgaggggctattgtccttgtgttcctgctccaaatgctggggggaggcagggagagactcatcagtggtataaatggctaaacttggccaagcacggtggctcacgcctgtaatcccaacactttgggaggccgaggtgggcagatcacctgaggtcaggagttcaagaccagcctggccaacatggtgaaaccccatctctactaaaaatacaaaaaattagctgggcgtggtggcaggcacctgtaatcccagctactcgggagattgaggcaggagaactgcttgaacccaggagacagaggttgcagtgagccaagatcgcaccattgcactccagcctgggcaacaagggcgaaactccatctcaaaaaaccaaaaggtttaacttgtgcacgatgcccagctggacaggctgatccttacggaccccccagtggatgttgagctcccatcagtgatgttgagcctgtggtaagcgggggctttgctacccccaaacacttatgagcacctggtatgggccaggcactgggccgggagagaggtgggagagatgaagacaccatctcttgaggcaaggagggcacaatgggatgggctgtgacacatcatgcacagcaggcaggactgtaaactgtcacaacacttctttgaaagcaatttggtaatatgcatcagaaattctaaatatccccacatatttcacccaaaatcccatccctgagaaatctatccaaaaaatgttaaaaagctgatttaggcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccgaggcaggtggatcacgaggtcaggagatcaagaccattctggctaacagggtgaaaccctgtctctactaaaaaatacaaaaacattagccgggcgtggtggcaggcgcctatagtcccagctactcaggaggctgaggcaggagaatggcgtgaacctgggaggttgagcttgcagtgagccaagatggcgctactgcactctagcctgggcgacagagcaagactctgtctcaaaaaaaaaaaaagtataataaattaattatttttgagatagggtctcactctgttacccaggctggagtgcagtggcacaatcatcactgcagcactgacctcgatctcccaggctcaagtgatcctcccacctcagccttcccagtagcagggaggacaggtgtgctccaccatgtccagctaattattattttatttatactttttgagatggagtcttgctctgtcgcccaggctggagtgccgaggcacaacctcagctcactgcaacctttgcctcccaggttaaagcaattctcctgcctcagcctcctgagtagctgggactacgggcatgcaccactatgctcagctaatttttgtatttttagtagagatgcggtttcaccatgttggccaggctggtctcaaactcctgacctcaagtgatctgcccgcctcagcctcctaaagtcctgggattacaggtgtgagccaccacacctggcctaattattattattattattattattattattattattattatttccaattcaaaaattttaatttaaaagtaaactttaatgtcaaaaatgcaaacttggggaggggagaaagatcacacgcaaagctgccacttcacacttgcagggctgcacggcagctaggcaaaggtgttcctcaattcccagacggtgcggcggccagacagaggtgctacttactcacttcccagatggggtggtggccaatgcccggcttaattattgtttttctttttttcatacaaacagacaccttactgactttttacatttttttgtagagaaaggctctcactatgttgcccagggtggtattaaactcctaggttcaagagatcctcccgtgttggcctccccaagtgttggaattacaggcgtgagccaccacactcagccaagaatcatattttctaagactatttggtgacacatgtagaactcacaatatgtcaagagaaaaaaatccaaaacgtataaataatatgatatagattttaaaaaatctaaatatatacatatagaacaaagatgggaaaaagcagccacatgttaagattatttctgggttgctagggatttcactcttcttctttaatgtctatatttcctggagctcttccatcaacatgttccttttacaatcaaagggagggtgcaggtgccggtccagggcttggcaacctgtgtggaagaaggctccacacctctgcttgagagccgccagggcactgtgtccttgggaagagtgggccaagacctgggggtgcagggcaggctctgggtaggtgctgaggaggtggggcactttggagagggctgtgtggagggcagcagcagacggaagcgacacagggcaggaaatctagagccacacaggatgtggccacaaaaggacagttgacaaggggcttccagttcagctagtggccaaggacagtgacagtaagaacacgcaactgtgggactgactgtctctgaagtgaccggcctcccaggataaggtcccaagtgatggtggagatatgaaggggtttccagactacagaattcaaggcctatgtggctaagaggttctggtaccttctaaagagaactagactttggtggttatggaaagggttgcgcttctagaatgcttccctctcaatgagaacagtagctccacgtggctgggaagttcaaagtggttttgacacagaaaagaggaagtaagtggactctatctttgatttgggatcctactcctgaccctgtgaacttcttggctccctcttgaggacgttggcttgaaagtggctctgtgggttctccctgctctctgacttctccgagcctgctggccactgtcttggctgagactgctctagtctccagaaaggagatctgctcactcctaagaagtatcaaggtcaggccaggtgtggtggctcacgcctgtaatcccagcactttgggaggccaagacaggcagatcaggaggtcaggagatcgagatcagcctggctaacacggtaaaaccccatctctactaaaaatacaaaaaattagccaggcgtggtggcacacacctgtagtcccaggtactcgggaggctgaagcaggagaatcgcttgaaaccaggaggccgaggttgcagtgagccaagattgcgccactgcactgcagcctgggcgacagagcgagacgccatttcaaaaaaaaaaaaaaatcaaggtcaggggggaagtgggaagactgaaatagataaaggattctaaagagatataacagtcaaatgcgacacatgaaaccctgaccagataaaaattaaaaacccataaaatacatgtttgaagtcatagagtaatctgacttggactagacatgtgatatatgtgaggcttgtgatcttcccaggagtgatggtagcacagcacagggcagagacccgtccatggaagaaacactggtgctagtgcccagggcagaagtgagtgatgtctttaagtggatatggaaaaatattaactattctacctaggttgtgggtgtatggatatttagtattcaattattccaatttctctgtgtatgtatacatattttttttagagacagggtctcactctgtcgaccacactggagtagggggtacaatcatagctcactgtacatactcaagtgatccttctgcctcagcctcctgagcagatgggactacaggtgtgcagcatcatggcccagtttttttttttttggtagagatgggttttgctagccgggagcagtggctcatgcctgtaatcctagcactttgggaggctgaggcgggcagatcatctgaggtcaggagttcaagaccagcctgggcaacatggtaaaaccctgtctctactaaaaacacaaaaattagccaggcatgatggcaggcgcctgtaatcccagctacttgggaggctgaggcaggagaatcgcttgaacccaggaggcagaggttgcagcaagctaagattgagccactgcactccagcctgggcaacagagcaaaaactccgtctcaaaaaaaaaaaaaaaaaaagagagagagagagatcggttttgctatgttgcccaagctggacacggacacacacacacacacacacacacacacacacacacacacacacacacacacaagctggacacagagacacacacagtgacagggcaaaggttccaaaattttaaacctggtaaatctgggtacgggtatacaggagttgttctactacactattctttcaacttttttgaaagtttgaagttatttcaaaagaaaaagttttccaaactttagtgatcctcctgcctcagcctcccaaagtgctgggatgataggcatgagccaccgtgcctgacccctctgtatatttttagaatttcatgttaaaagatggaaaagtctggatgaggtagttcacgcctgtcttcccagctctttgggaggccaaggtgggaagactgcttgaagccagacgttcaagaccaacttggccaacatagtgagaccccgcttttttctaactaaaaaaatttttttccaagttggaaaaaatatctagccataagacaaaccttgaaactgcaaaagaacaatggagtatgtgtgacaggaggtactgctctacagtggggttaaagccatacacaagctgtggtggctcacgcctgtaatcccagcactttgggaggccgatgcgggcggatcatgaggttaggagttcaagaccagcctggccagcatggtgaaacccgtctctactaaaaatacaaaacattagccagacgtggtggtgggcacctgtagtcccagctactagggaggctgaggcaggagaatggcgtgaacccaggaggcggagcttgcagtgagctgagattgcgccactgcactccagcctgggcgacagagcgagactctgtctcaaaaaaaaaaaagccatacacaagctgttaccactaaatgggaaaatgactgaaaaatgtcaatgtcaagagggactgaaatcaaatttttccaatagtgggttacatgatcagaaatccaaatagacaggaaatatgttggctttatttatttatttatttatttatttatttatttagacagagtctcactctgtcacccaggctggagtacagtggcatgaactcggctcactgcaaccttcacctcccaggttcaagcgattgtcctgcctcagcctcccgagtagctgggactacagatgtgtgccaccacacccagctaatttttgtatttttagtagggacggggttttaccatgttggtcaggctggtcttgaactcctgacctcaagtgatccacccgccttggcctctcaaagtgctgggattacaggtgtgagccaccacacctggccggtactggctttaaaaataacaaaagtaatacatacacatagaaaaaggtcaaacaaagaagtacatagaatgaaaaatgaatgctgtgtcccctcccagaccatttctgtgaataaatatgtaataccatgaaatgatgaggactaacattttctgaatgccaggcaccactctatgtgctttccacacattcattaacctcatttaattttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggccttcttaactggggagccttgggtagattgcttccatttaacttcctgaggttacatgcaaaatcttgagagtaataaggatttccatggacagagagtgcacagttttcgaaaaggttctctgtgacctaaaacatgttaatccacacacacctggttttgcaggcactgagaaaataagtaaaccttccaaggccacaaaagtgactggtgacacaagtaaacttgctctcagtgaaatacatgaatgtttttccagaaggaggtgcatcttattaaatcactattatatgacagtggaacaactaagtctctaagcattagataccattcaaaacgtttaactaacaagctaagtaacaactgaagtaatttaatcaatgatatctctgaagaaatattattcacaaagttgcggtacaaagatcaccaaatctagccaggaaggagcctcagagattgtatgacccagcttcctagcaactccctcaaagtcactgagaacagctgcattagggccaaaacccaggcttcctgccccaaatccactggtacttccattcaacagagtaatctgagacactgtgtcatcaaaggtcacagaatatactctatatacaaaatagagtatatctttcttttaaaaaataaaataagtaggccaggagtggtggctcacacctgtaatcccagcactttgggaggctgaggcaggtggatcacttgaaaccaggagtttgagaccagcctggtgaacatggcaaaaactgatttctactaaaaatacaaaaattagccgtgcatggtggtgcacacctgtaattccagctgcttggaaggctgaggcaggagaatagcttgaacccaggagatggaagttgcagtgagccaaaatcacgccactgcactccagtctgggtgacagagtgagactctgtctcaaaaataaaaataaaaataaaaaaatttaaaaaaaacaaacacacacacacacacacacacacacacacacacacacacacaacaaaaaaaaccacctctggaaattagtttcttccagaaggtccaaggggtaaccataaagtaaatgcaaggacccatgatctctgtgctctttgttgagcaataaaatcaaatatttgtttcctcctccataatataaccattaactttcactaaaaatacacttattcttctcatgtaagaggtcacatcaggggagtatttaaatgagcatgtgctaagctatcacagataacagttctgcctgtaccacccaccccagcagcccggagaggcgcaggctcacacacgatcccacatgtaggaccaggagtccaacctggaaccctgtgaccctcaaatttgtgtaatttcaaccaacctcaccactcactgcttccctaaagtgcaaagtgcccgacagatttccactatgcatatattaagctctaaatgacaactgctcaacatatttgaaagttcacaagaatacaggtcatcaagttctgatggtcaaagatcctggaactcactgattttagtgttgccctaagcatcctccctatctgcctaaaacttgctctcctgcagagcctgctgccaacagagtggcttgggcttcatgccccttacttttccctccaggccacataaaaggcccacatacaacagcactttaaacacacaagcatacactactcaacattagctacacagtgggaaaatttctgttttgaaaaatcaaccaatggggccaggcatggtggttcacgcctgtaatcccagcactaagggaggctgaagtggggcagatcacttgagctcagaagttcgagacaagcctgggcaacatggcaaaaccctatctctacaaaaaaatagaaaaagtagctgagaatggtgatgtgcacctgtagtcccagctacttggaaggctgaggtgggaagattgcttgagctccagaggtccaggctgcagtgggctgatactctgccactgcactccaatctaggtgccagaatgagaccctgtctcaaaaacaataaaaataaaaataaatcaaccaatgggggtgtccatgaaaaataccatggcaggccgggcgcggcagctcatacctgtaataccagcactttgggaggccaaggcgggtggatcacttgaggccaggagttcgagaccagcctggccaacatggtgaaaccccatctctactaaaaatacaaaaattagccatgcgtggtagggcgtgcttgtaatcccaggtactcgggagactgaggcatgacaactgcttgaacccaggaggtggagactgcagttagccaaggtcgcaccactgcattccagcctgggtgacagagtgagaatctgtctcaaaaataaaaaataaaatacaatataataaaaaataaaaataaataaataacatgcgacatatgacattttactactaaagataaataatggcaaaccagtcagttactatttttcatctacctcggccagccaaaactggacaccctagaagtccccaggttgggaataatgatgaacactcagatggtgtgagcaggggaacgacttcaatgagaccaggagaggtgcctctctgtgcctgcaatgccacctgtctgcctgacctccacgtccctaggctgccctagcagttctgccaccaggcccacccctctggtgtacaaggtgaaggggacacatgcaagtgctcaagactcaaactactatggggtgaggaggagggaaggcactgtaaggcagacacaagggatggcctagaaggttggttaaatggaagggagagaatatggaatgaaaataaatactggaacataggtgctgggcttaggacttgcagctaggagtgacgaagaaagggaaaaacaacttctacaagtcatttgggaagaagcggacccaagctgggacaggacaggatggaaacaggctctccaacacgatggtgccacacaggaggcagggactgtgcccgccatgccaacaacgtcccctgaaggagactggggccatagctccgaggcctgagcgccgacaagaggcttccaggcctgcacttgtgggaaggagccaaggaagggatggaagcagggagctggcccagcatcagtcacaagggcatgagacacaggatgaaagtggagtcagatttaggacctgggagccacccggcagggaaccaaagcaagtgcccttgtcaattggttgagggggttcgggcaggtcatggagaaagggagtgaaggatgtgccatggtggacacacctatggggctgtcatggaaaagctggtgatggctgcagcagtcacatctagaggcataggggcctcaacactgcacctttctaaggaatttactgtgcgtcaccaggcaacacttaaagcatgaacacagtatctgcagtttttatcattcaattaatgaatactcaccacagctattacaggaatgagtactcccaagttccctgcactgctagaagcctagaaaagaacagaattattgtcattaacgagtatgtgtttcttttattaaaaaaaaaaaacacaagatacaacatagtgttatgtaaacctggaatgtcttaatctaagagaaatgatgagagatatgcagagagaggcagagagatgctcatccagcataattttaatagcaaaaaatgaaaacaaatgtgaaaaataaaccatggttacataaatgattacataaatcatggtacttctgcataattagatatgacacagctatttaaaatacaactttctgaaaagcatttagtcaccatggaaagagcccacagcacatgtcaaatgaaaaaaaaatcaagatttaagactatgctatgattcaatcccaattatgtaataaatacatatgcataaaaaagctaggaagaaatctgtcaaagtgttagtaatgattatatatctgagtcaagggataagtgctttttactttactatttataggcttctgtatcttttctaaaataaacatatattcttcccaagttagggaaatttggggggttacttaataaaagatagactctctggctagacacacaaatgtagctaatcttcagtacacactgattagtaaaaattctggaagcactggcctaagccgacttgatttatgctcttaatctataataacagcagctgaagaccttgagcatacactgcggccaggcactgtgctcagtgcttcgcatgcactaacttctgggacgattcatgggaggtctcagtagcttgccaaggccacacagcacctcagtggtggggacagaatgccaagctgtaaacatatacacctactatgtactcacaaaaatttttttgaaaatttaaaaagaatgccaagctgttttccctgggctgggggccacaagggtggccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttctctcctgtgcactgaggtggtcccagctgtgtaccccactgggagacttgggaagttagtcagccacatgactgtcggagggcccggcatagcaaggctgaattagggacaagagtcttaggatccctgcttgcatcggccactctctcttggctgagactttcacagggggactccttcatgcagttgtcatctcaaatgccactcttcagagaagccttctcaaccagcccaatctaaagtgcccctcaccaccctgccctgtttcactctcccactcagcgccacaggcagagaggaccctgtctgtctcgttcacttctgtaacaccctcatctagagcaagggctggtaaactatggcccatgaaccaaatccaacccaacacctgttcttgcaaatacaattttataggagcacagtcacgcctgttcgttcatagacaggtgaccacagaagagttgagttgagcagttacaacagaagctgtatggcctgcaaagcgtaaaatatttacactctggccctttacagaaaaagtgggctgacccctgacctaggacagtagctggcacagagtaggtgaacaataactgtctgggggaaggggaaggaagaaatggaagagagaggaaatgacaaaacagggtggaagtagagatatggttgtgggatacattggggtttttctttaaataatctgatcaatcttttattttttaatttatagtacccccgactttttcttttttttcctttttgcctttattaaatgcctaaacacgcctcagtaccaagtgttatcaacaccaactcatattcctttccttatttaaaaaaaaaaactttctagctcattacaaacacccccttcccctttctctccactttcttttacatacccaccctatctaaaaaaatcaaatgtttagccaaccaaaattagtttaaattatatgacccaaccccagccaataaaaaaaatacaaaaacaaaacttgagtcaaaaataaaaattctcgtgccctttattcaaatatgctcttataacagctagcccaaaagacacccctctacgcaaaaataaaattgctttactaaaactcttctgttcaaatattcaatttccttaaaattttaagggttattcctaacatggtagagcgactagtgcccacgtgacatgctactggggagttacgaaggaagaggcctcacctgcctcggccccaccatgaatgtatttggggattcaagacatgacgtttatctcagtagacctgtcttccttgggaggcctgagattaggtgaaatctggcccttctcatgttgccactgtgttctgatgatgggcccttaaagtcctcctaggcccagctaccacccctgggcttcatgataaaggcaaggacagagagaggtgcccgtggggagctgaggctagactgttgtcatgtcaccaccctaggatgggtcgggcagcttttatgagctggatataacccagtgagaaaactgccctctcccctgatccccaccagcatccttgagaaagaaccccaccccttcttacttgcattccaggcacatttaaatcattcacaaagaaagtgccatattccaaccaagatggtgcctgaagactaagccttggccagcagggataggacactgatggggaaggcatagccatcctccttcctacctttagggcagggcccttctcgcttgccctctcgctggctcgcttcccctccagccccagctgcacaaacaactccaacaggttcatgagcagctcatccaccaggtgctcgtcttggatgttggccgcgatgttggccagggcattaatcactgccagggagcaatgcctgaagaagaaggagtgaaataacagccactgccaggccctcaaccgtccccaagggacggcactgcaggggtgaggcgagctgagcgggccaggcccagcctgccttaccacactcctcccagtgtctgtaaaccaaagaactctcaagtggagaagaacatgtcatcttcgtgaaaaacaacctgtagaataaagccaactgatgcagaaatgactgcaatcctctctcctgaaatgtagtaaggacctccaggagactaagttctaggcatctgcaacactgggtacctgtgagggtctcaggacacttccctcagggctgaaaatgaaagggcccatgcccaggcattccaggttggatcttgcttcccccctacaaatcacaaagagccttaaagcatcatttaccacccacagaactttcacctcatgaccagcttctccctaacgctgcctccaccttggagctgatgtcagtattttttcacatccaatgctcagcaagtgttccagggtcctgcctcaggatcttggctggcccaatgtaaaccccggatgtgaagctgacattgcccctttggccagaaacctgaaaccactgaggccaaccaggcttctgtggccctggagactgccagactctgtcatgtccaagcggcacgaccctgggtaagtctctttaagtctttgagcctcagtttcttcctaagtaaaacaaggatgataatttctcttcgtaggatcacgggaagagtgaaacaccacgtgaagcactaagcatgtcgtctgctccactaagaaatcccagagcaacggcagccacggcaaaaggcactgcagttaagtaatacctggtaggtcaagggcaaacaaagggcagtaaatgcttccactggtgaggaagacgacaaatcatttttggtgacaatatgagaaaaggctttatggaaggagaggcaagctgagccagaactgaagaactggaaggatgaagactggcaggtgctacagacacagggtaaggcatggcagaacacctaggaggggtggaagcaaaggaaaccggggaggcagctggcgaggcagctggggacactcctggagaaagggcccagcagtcacataggcgcaaggaagcaatgtgttggcctgtgtgcaggttccatggcagagaatgggacagaggaaggaaggaaaggagagcctgaccccatccccaatccagtcttcaggctgttctagtagcctgggctcatgacggtggcagcaagaaggcaatgaagtagtatcgatgcgagagacagctctattgattgggagctttcacatatgcaatctcattcccaactgcaggcaggttctcatttggcagatgaggaaactgaggcacagaggttcagcattttctgaggtcatgcagctacatggcatggctccacagctgcactcccacccactaaactgacatggagagaatccagaggaaggcctggacttcacagtcagaagggaggagcccggaggtcaagaagagtaacgcctgcaaaggggctctcttcttccctccccaccctcctgtcctcatctgacttcacctctccccttccctctcttccaaacacggatgaacatgtccctgtcctcaaggcattcctagaggagggtaaggaatagccaagaagcatctctcaatctgtcagggaaaactggtcagactttatacaagtatcaaatgttcaaggacgtttaacgcctacttccttggacccaaaatcctacttctctgaatctaacccacagaaagcatcaaagatgctcagagatatgtagctgttaggctgtcaatgctgcatttattagtgggaaaactggaaaacaccctaacatccaagctagagactggctggttaaatcttggttctactataggataggacgctccacaacctctaaaggcaacctgcgcaggatcattcatggtgtggctgatgtgctgccccataaaaaagcaggtcagctgcatgtgcagcatgggcccaatcagaaggagagaaaggagctgagacctcgtgcgctgagatgctcagtggtcacctccaggtgggggccacattgggttttcacttccccccttatgtgtgcactgatctgtagcatatagttttcttgcaagaagagtttatttaagagacaaattcacaaacctcacatttttaaagtaagttaaatactgtcatgataaaaaagtgacaatgaggtccagttacctatagccgtggtccttgtaatctttggtggctgagtatacaacggagctggccttcacactgatctgctggaagaggttccacacttcctgatagatgtattgctgggagagagcaagatgcactgtcaccatgcaggatgccctcatgaggcccctcctgtcatcacctagagagaaagctctggaatcctggggcacaacagcccaaagactatcagcccaaagatcatccatttctaaagctttaatcaaacctcaaattaaaagctaaaagggacatggcttagattcaaatcttctgttataatacactgacaagaaattaaacctctttttccccagcactcacagcatcttacactattcttactactccgcattaaaaccgttgtcagcatttagctcatctgcaaggtatatttaatctgtatttgtacatcccttatagtcaagagtttaacgtagcttgcacagggttagtggtgttctggctctggcctcccttacatttccggtgataaccaggcagcccagctggtcaataatcagcacatcgaggggggagggtggctggcagaatttctgctgtaggatctgcagaatgggctccatgaccttcggggtgtccctcaaggccaccgcaatgtgtcccaaggctcggattgtgtggtcgggaatcaagtgagcgtccctacagaaggaagaacagaagcgccctagcaacagtccctccagcatgcagtagtgaaacagtacccagagactacgatctagaccttaatttcataacagtcttgatgcagtgttcatctgaaactgacagcccaggattttaaccacgggcagaaacataagccccaggcactagtctggatgacaaagatctttctcgacttccacacagtggtccaggaagtacaatccaaggtgggcttcaccttaaatcttgtgacaaccctgatacatgcctatgctctgagacaaggagataaggacagaggcatgcatacgcacaatgccaggtgccccacacgagcctgctgagaacaatgggctgcctctgagagacaggaataggggcgtacttgtcgctctcctgagagatgtagagccggttggacaggctggccaagaacgcctccacaatcactgggtccaccgtcaatccagccttcaggcacctgaggagcaagaaaacccatgtggcactgaggcatcaaaccaagataggttttttgttttttaatttttccttccttaggcctacaaagtttaaagaactgctctgaattttcttccccccaaattggaggtcataacacagaatgaattcaaagaattactccagattttgcccacttgataaatgtctcagtcggaaacaataatttcattattttgcccagaacagtttcctttggaatatcatgctcaccctaattccaatttcaatcccttgtactgtttcttaaggtcacagtgactgattccaaagacaaacggtcccaagatagcatagtaaacatcacaattatataccaaggttttcatggtaaggagaaacatttacgttacagagaaaaggggaaaaatttaaagcccctaaaaacataaaatcttgtaagatgtcctagctctccacatctgtttggctcctgggccagagtttggaaaacagtttgagtctgacagacaagctgccatcttgatttagcttctaagggcaaggaaccagaatccagggaaagaagtatttgcatggaaatcagactgtatgtagctctcaagttggaagaacaagagtccacagtgcaggagtctgggcagcaaggggtacctaatcatattttaaaacctcacatttatattaaacattccacagaaaacaaggtaaagaaaatatgatgatacgttactctggatgttgagctaatggataatccttctctttttacttttctatacattacaatttttctctagtaagaatttcttagccaggcacggtggctcacacctgtaatcccagcactttgggaggcacaggtgggcggatcacaaggtcaggagatcaagatcatcctggctaacatggtgaaaccccatctctactaaaaaaaaaaaaaaaatacaaaaaaattagctgggcatggtggcgggcacctgtagtcccagctactccagaggctgaggcaggagaatggcgtgaacccaggaggcggagcttgcagtgagctgagatcgcgccactgcactccagcctgggcgacaaagcaagactctgtctcaaaaaaaaaaaaggaagaatttctttttttttttgagacggagttttgctcttgttgcccaggctggagtgcaatggtacaatctcggctcaccgcaacctccgcctcccgggttcaagtgattctcctgcctcagcctcccgagtagctgggattacaggcacgtgccaccacgcccggctaattttttgtatttgtagtagagacagggtttcaccatattggccaggctggtctcgaactcctgacctcatgatccacctgcctcggcctcccaagtagctgggattacaggcttgagccaccacaccaggcctcttattatgtttatgatcaggaaaagaaaagaagtaacaagaaataattcctctttatagatcaagtgtaggtttaaaataatcagaaacaagctttaaaaaagtataaatgcagccaggcacggtggctcacgcttgtaatcccagcactttgggaggctgaggcaggcggatcacgaggtcacaagtttgagaccagtctggccaacatagtgaaatcccatctctactaaaaatataaaaaattagccaagaatggtggtgtgtgcctgtaatcccagctacctgggaggctgaggcaggagaattgcatgaacccaggaggcagaggttgctgtgagctgagattgcgccattgcactcccgccccaggcaacagtgcaagactgtataaaaaaaaatgtataaatggggtgggtgcagtggctcacacctgtaatcccagcactttgggagaccaaggcaggtggatcacctgaggtcaggagttcgagaccagcctggccaacgtggtgcaaccccatctctactaaaaatacaaaaattagctgggcgtggtggtgggcgcctgtaatcccagctactcgggggaggctgaggcaggaaaatagcttgaacccaggaggcagaggtagcagtgagccgagattgtgccactgcattccagcctgggcaacagagcgagactcaatctcaaaaaagaagtataaatgtctcttattttgtaataacccgcttgtctggagcactgctgtctactcgccacttgcccagcttcccacctgcagatgttgtcaatagcgatgtctcggagctgctcgtacatggagggctggctcttcttacccgacatgacgttcagggttgactcggaatgctcattggtcacactgatttttatatcattgccagcaactgaaagtaaaaaattcaaatatatacctagttaggcctatcattttccatcaccttctttgtaattcaaaaaccaagataatatgctgatcatttataaaagcaaaatgatcactctaaaaacatctgaccaaatatttcagaaagagaagagtctaagagcaacaggaaataatatgtttaaatcaaaaggaagaatattcaagttagaaagtgataaatacagaaaactaccaatttctcaatcaactgttcaaaagtactgatgaccaaccaccaaaggcagctctgagggcgactgaggcatggccctgtgcttggagttacctcactaatatgtacaaagcctggtgagggttagggatgcttgcgggagcaggggccttagagcctgagagaaccctccccactacggggttcagggaagtcttgttttttgtttgtttttgagatagggtcttgctctgtcacccaggccggaatgcagtggcgctatcacagctcactgcatcctcaacctcctgggctcaagccatcctacaacttcagcctcctgagtagctaggactacaggtgagcgccatcacgcctggctaaatctttaaactgctctgactttaagtcttcatctgaaggggaagataaaaacagccaccttcatgagactgtgggtaagagggtgatactacatcagagacactagcacacagcaggtgtttaattaattaatgttaattattgtttcatcatatgtggaaacatcataatccattctcgcaggggtagcagggactgggcccctggctaagtgtttggggcacacaggatttgcatttcagacttccacagtgaaagatgtcaaaaagaaaacaggacttgaaggggcctttggtgtaacaggaatacaggatgagagaaggccggggaagaaaggcctggagcttggaggggacgcaaagggaaagacagaaggaaaggtgtggcgaaggaatgcacccaggtacagtcatgaaacctgtgtgaggctcacacacagtcacagagcccctttctcagggcctgaagggcacatagtctgttattacctgtgtggtactgactgtggtacttgtagagcttcaccagaactggggacgggatgaccaggaagtctcgcaaggacggtgtcacagagtgcaccaccaccgggaacctctcgcacaggcggcccaaaccctgcaacacaccatcaacctgtcacatggcctgtggtatgggaccatctgagtaggccctgagcagggaggtgctcaacccttcagtacccaagtctgacccaaaacttcgaaggtcaaagctcccacaggccacctgcccaggacataaaaagatggaagcgatggtgctgactctcctccacctataggggacatcaactactatttttttgttttgtttttgagacagggtctcgctgtcgcccaggctggagtgcagtggcacgatcatggcttactgcagccttgacttactgggcttaagcaatcctcccacctcagcctcctgagtagctgggactgtaggcacacaccatcatccctaactaattctaattttttaaattttttgtgcagacggagtctcactatgttgcccaggttgggctcaagcgatcctcccacctctgcctcccaaagtatcgggattacaggagtgagcaaccgtacctggccaggggatatagattgttaaagtgtgctcatctcttttggaagcatactaaagaagaaagggacaaaatataatttttaaacaatggcaggtgtggagtcagtgggattgtgacaaggttaagagtctcggcagagcagagctagcactgtgggtgtcaggagacatccccttgcgtggccccatggcacatgtccacagtccttcccccacaggccttgggaatggcccccagcctcacaacaacggagaactgaagccagctgcacccatatgccactgacagaaagccctggcatcctgcagggggcagcccacactcagtgatgaactgtgcacagcacgcactggttaaagctcctaaagacagaaccggcagggtctccgctgctggtgtgcccaccacagcctgaacagcaacagcgtgacaagagggaggccctacaggtgggatctgagcctctctgggttcagggagactgacctgcagacagcagatcagcaggggcaagtgagcaataatgactttgctggacgtcttggactgcagcttctcagatagcttgatgcaaaggttttctgcaccttaattcaaaaccagaagaggagatgagtgatcagcacaggccagtctttctaacacacttatccaccaagtaagcacagaatttaataaaaccccagagacatactttaggcagggcttattcatactgagaggtcacacagtgtgtgacactctctctctcttctccgctggccctaagcccccttgtccccgcagtgttcattccacagaaaacttcccattctactcctcccccagaaaaacacttcacctgaaggcactgagcttccatgtcaccacagaaaagcctaaagaaccagcaagatgcagcagagagcatacacaggccctgaggccacgggcatccccatcctcccaggtccagtgccctccatgcaggacaggacaccagacgtgcagagcacagcaggggctaatgctccactctgcacgtgcccaggaggcctactgcaactgcctgtgctggtaacagagccaagtgttctagaagtagtttggggaaacttgtggcaagaaagcctctgggtcatgcctggagctcacatgagaggcaaggcagtctgtctcaccctgctcgtccttcacagcccacaccatgaggtccacacaggcagcattcgcctgacagcgcagtttgagggggctcagctcattgtggatccggtctgcgtcatgtagaatcttctggagctccccctggctcgtgttgaactgctccagcacaaaatcatggatctccttcacaaaagaggtcgggaggtctgtaggaaagagtgtggcatcacagctgggaacaaaactacagtagaacacaggcagtgctagcagcggctacagtcttccccttttaacaaaaaccccagaaaagtagcatttgctactggccactgtgggtcctagaatgcccactggaaagaagttggataggaattgcacagctgtcctccacgtgcacacaacctggcaatcagaggaaatgatcatttcccagggatgttacagccatgctttgttttaagcagtcaacgtactaaaacctgaatacatgaaacatataaattgggaagtatcgttgctggaactacttccactgacaatatgagatacttctgtgatttttttttcttttaagaaagaggttgtcagggccaggcgcggtggctcacgcctgtaatctcagcaacttgggaggccgaggcgggcagatcatgaggtcaggagatcgagaccatcctggctaacacggtgaaaccccatctctaataaaaatacaaaaaattagccgggcgtggtggtgggcgcctgtagtcccagctactcgggaggctgaggcaggagaatggcgtcaacccgggaggcggagcttgcagtgagccaagatcgtgccactgcattccagcgtgggcgacagagcgagactcccatctcaaaaaaaaaaaaaaaaagaaagaaaaaggttgtcagataagggcaaaaactggttgcagccttgagaagagaattatctggatcttcagagcactcaccctgagtttgagagacttttcaaactctcatccccagggcctggaaaattcaggagaaccaccatgatgcacgcacaagtcagcccagccaaggcagccagcaacacacagcaggggtggtggggagggcaggggtaatccctgatgccccttcttagggagtttcaacccttgccgtggcccagatgactcagcttctgaggaatgttcagaatcagattaggaaagtggttactaaattttggtataccttcctgacaaaatattatgtgctcatcaaaacttaagcttacgaagaacactcaacagtgtgaggggagagcataggaaaaacattttgtaaaatgcataaaagattgtttcctcacttctgggaaaaacaaaattcatgaaagagggactagaagaaaatgctaaattgttgtgtgtgcatgttaactattaagctattgtctcaggttgggtgcagtggctaacacctgtaatcccagcactttgggaggccaaggtgggtggatcatttgaggccaggagttcaagaccagcctggccaacatggtaaaaccccatctctactaaaaatacaaaaattaggcagacgtggtggcacatgcctgtaatcccagctacttgggaggctgaggcacgagagaattgcttgagcctgggaggcagaagttgcagtgaccccagatcatgccaatgcactccagcctgggcgacagggaaagactctgtctgaaaaaaaaagctagtacctctacattaacagattacatgtattacaagtacttcattttcttttttttaatgtttttgagatggagtcttactctgtcacataggctggagtgcagtggcacgatctgggctcactgcaacctccgcctcccaagttcaagcgattctcctgcctcagcctcctgtgtagctgggattacaggtgcatgccactgcgcctggctaatttcttttgtatttttagtagagacagggtttcaccctgtttggcaaggctggtctcgaactcctgaccttaagtgatcagcccaccttgtcctcccaaagtgctgggattatacgcataagccactgtgcctggcctcttttttaattttttaaactatctaaatggatatgtaaaactgtatctgtccttaggacaatataacatgcacattttagataaacaccttaggaaataaactcagcaaaggagccatcatcgatggtaccggggttgcaggatcatggacagattttttaaatttgcttttttcccaaaatttcagtaacatgaccactttgctcatatgtgtttttcagtggccccagcagaaagtgagtaccagtctgcaaccactagcatgcgacagtggcctgggagccagtcttgctgtactcacaaacacatgggcaaactgtcctcacccttcatgtagtacagagtgtcacgcagcatcttgaacatggtcaggtagagagggtcactgaaggaagtgtagtagagatcagcactggggttggcctgcagggaaggcagacacacatgactatagaacagaaatgcccttctgcccaccctttgccttcacagcaaggcccagcggaatggtgattcgtgacttagcattctaaatgaagcaactgtttatcatgactcatcacttggacactctactgtcttcatcctcttaagcatcagaccaaggaaaacaggaggctcatgcagtccagagatgcctgcgggggagcagccatctgcaccctagtaggaagaacctccttgctgtggctgaagctcaccatctttggccatcattggcccagacagggacatgggaagtggtgaaggaggaagactgacaaaggccaccagagtaagggatccacactgtccatcatcccaaggatacaaattacagccaggacaccttcagatacaacttatgttttgtaattaaaactcattttaaattattctttaggaatctatttgaaatgtagcactattcttcttctgaaaaaaaaaaaaaaattcacacaaggtctaatgagttaagaaagataatagtccagcccgggtgtggtggctcacgcctgtaatcccagcatttggggaggccaaggagggtggatcacctgaggtcgggagtttgagaccagcctgaccaacatggagaaaccctgtctctactaaaaatacaaaattagctgggcgtggtggtacatgactgtaatcccagctacttgggaggctgaggcaggagaattgcttgaacctgaaaggcagaggttgtggtgagcagagatcgcgccattgcactccagcctgggcaacaagaacaaaactctgtctcaaaaaaaaaaaaaggctgggtgcagtggctctcgcctgtaatcccagcactttgggaggccaaggcgggtggatcacgagatcaggagttcaggagttcaagaccagcctgtccaacatggtgacaccctgtctcttctaaaaatacaaaaaattagccgggcgtggtggcgtgcacctgtaatcccagctactaaggaggctgaggcagaattgctttgacctgggaggcggagcttgcagtgagccaagatcacgccactgcactccagcctgggtgacagagtgagactccgtctcaaaaaaaaaaaaaaaaagataacagtccttaacttctatatactcctagttgagtaggatggaaaattatggtttatcataactcgtttttttcatttttttttttagagatagggtctcactctgtaccccaggctggaatgcagtggtatgatcacagctcactgcagccttgaactcctgggctcaagtgatcctcctgcctcagcctcctgagtagcagggactacaggcatgtaccaccatgcccagctaatattataattcttgacaagtataaaagtggtctgcaaatatagcaaatctttaaggcgccagaagttggccagagtgggatagggcatgcagtgtgaggttgacagagggtgagtgagcaggtggagaaaaaaagaatcatgtggagagtgtgagagtcatgccaattcccaggaggacactgacaggaagagctgtggttgacagcactgcaatgatggctttacagacaacgtctggtggtcctcacagggcagaaatggagaaatgagactgggagaggttaaagcagttcagggctttgactctgggagtccagacaacacgagtgttaaactttggagccttggagaccaaccatcttacaagcccacagcccagctccatcactcacgagctatgtaaataaagttcctgagctaagcctcagtttccccatatgtaaactggggattgttgtgagattcaaggagtgagtgagtaaagttctggcacataataagcatgtaataattggtagtggttattacactgattatggatactgagtaatatattgcagactctaggtcaagattacaagaaacttttttttttttagctatgaaactgtttcttcaaatggatgtttatgctaaagaacaaattacaaaacaaaaaataccagaaactgccctggttcaatgagaaggagggtcccagaggtggagtgcaggcccactaagtctccacttgtctaactgcccagcccagctctcgccctggtcctcctggtctgccctcagtcacaaatgatcaaacacttatgatggaaaaccaaaggtctctgagaccacaagctcagtctatagtgagtgagtgagagagttaaagctcaggccaatgggcagaacgacaacctgaaaaagggttggagacaaggtaggaactgcccagatgcaacttggggagttataagaactctgttacttaaccaagaaccaacccagaccaaaccacggccagcacatacatctcacatctgcaatagctcgttggcaggggtacgaagcaggaagagacatggtctacagcacatgaagggccctggtagttccttccctgcttcatacctgagccccaggtacagtggtatcaggcactgtgtgtcttaaaatcaggtgagagaaggaacaccaggcttcaataaggaatctgggtcagggacatacccatggtaataattagcctggcaaatgacaacctgtctgcatcctaaccctcaagaggggcctgacccaaatgttccccgagatttttgagacctcccagcaccaatgtaatgatttcataaataatgctgtaggccttggttccaaatacattaaagacaagagttccagccgggcatggtggctcacgcctgtaatcccagcactttgggaggcagaggcaggcagatcacgaggtcaggagattgagaccatcctggctaacacggtaaaacccagtctctactaaaaaatacaaaaaaagttagctgggtgtggtggagggtgcctgtagtcccagctacttaggaagcggaggtaggagaatggcgtgaacctgggaggcagagcttgcagtgagccgagattgcgccactgcactccagcctgggcgacagagcgagactccatctcaaaaaaaaaaaaaaagttccctagttacgcaccccttacacttaaaaaccaggacttgcatacgcctagaaaagtgtagctctgagcccagaggagcagctttggaagcaccaaaggagtgaggaagataaaagagtaggagagacccaggccagactcccagctcccacagtaactatgtgatgtgggcacgttagtgagttctcactaaaactctatcttctgtctgtaatgccaccagtcagaggcaccctgaggtgacgtatttaaaagagcatgcaacggtacctaccacagaccaagccctccgcggcaggtggattgttaccacatgaacaaggaaagtgaaaacactgcaaaaccccttccactccagcccccgctcaaactcttcctgctttctctacacacgtttaagtcaggctgatctcatggtaatgccctcagaagcgacatacctccatcacactggctacaatggcatccaaagatttgagaacagcctcctcaacgatcttcttcacctaccaaggaaacagaacctcatgaagcaactgacatacacagagacaggaatgctagctccttctaccgaaaacccatgacaaactcacatggtgaaaaatgtgatgcagataaaggccaataaatacaaattatggctatgtatcaaactatatgcacaaaatgcctttaattctgaagtcacttgggactgcttttctaccttagatagcaatgacataaaaacaaaggaaaaaggccaaactccctcagatttgttgacctgagatttctgtttccaggatgtgcagacctcaggccttgctgccatttcacccactcatggttaacaggcacagttgtgtgacatcctcttgcaatcccctcccagacatcaaggacaccctcacagccagtccttggagctcatggcacctccttcctctccgggccaggtgcactggctcttctacaactgcttaggtactcaaactagagctcatattttaaattttcaatagaagcaattattttcaccagttatctgtacagtatttagtgtaggaatgaattgttctgtcaactgcagaaccacaaaaaaaaaaaaaaaactgcccacatccacaattgtagtatttgatgaaagtcatttccaaaatgtatagataatgataaacatcctaggaaaagaaatgaaaaaccgcctaaaagaaaacctaggccagccgtggtggctcacgcctgtaatcccagcactttaggaggccgaggcaggcggataatgaggtcaggagatcgagaccatcctggctaacaaggtgaaaccctgtttctactaaaaatacaaaaacttagccgggcgtggtggtggtcacctggagtcccagctactcaggaggctgagggaggagaatggcgtgaacctgggaggcggagcttgcagtgagccgagatcgtgccactgcactccagcttgggcgacagggcgagactccatctcaaaaaaaaaaaaaaaaaaaagaaaacctaaacttgaagaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactgagaagcagtttaggtagttttccttcttgacagcaacttcaaaaacatcctagcctatttagtaattcattatggttccatcctcattaattattacctatgttgtaatgtcttcttacatcttcagcctgaagccattctctgagggatttctattcacactccacacagcagggaggtggccactcctcagcacatgctccatgctatccaaattgttctcatttccaagacagcaagcccaatcttgagagtctggccttgatgacatcatcacccgtacctattcaaatctgtcttgaaccatcctagcttgattgtaacaacttcagggcccctggatctttattttgtaattttttttgagatggagtctcactctgttgcccaggctggagtgcagtgctgcgatgttgactactgcaacctccacctccaaggttcaagcgatcctcctaactctgcctcctgagtagctgggattacagggatccactaccatgtacagctaaagttttgtgttttttagtagagatgggatttcaccatgttggccaggctagtctcgaactcctgacctcaagtgatccgcccactttggcctcccaaagttgggattactggcatgagccacggcgtccaaccagggtccctgaatctgaccaaagctctggccatttaaggaatcgaacaatggccctggtgttttctctggtatcaccctcaatgtcatccaaaggtacccaaatatgaaaaagtcaggttttgttattaacccaaatagagccaccccttagaggaagtcaagcccaggaaaagcactggacttggagtcagaatccctggactggatgcagcccagctgctggcctacatatccatgacgtgtttgacaccgatttcctgacctccaaatggggatgcatgggtgcctccccaacatggttgctcaagaatgaaatgagaaaccagtatacaatgattccatgaatgttactctacttccttcattaatctgcaagtttatgactattaaattgtactttgaaatactggtactctgagtttttcttttaaaaatacaagtttcaccactagcaattttactgacatatccatggtctgttcatccatcagttctttgcttaccaggtttaagagttcccgaagcatttccaatggaatgttaaactccttatatgtgacaccgttgaaaaggggagagactgagaagctggagctgatggttgaaaagtagtactcaggctctagggcagtcccatcgggcaagcaggaggctggtgggagataaagctggaaactcagccgtggtgacaggcaactagggtacttcctcaagctgactcccccaataaccaacaaaggtgcagattttgcctttatttatatcccaattctctgcatgtttttaaattaacaactacagggtagattgcaaatccttggggactgatgcccctcacctgtgtctttcaggtcaaagactcagatatgatggtcctaatatttccatcttagacaatataacttagtatgtgggaagtgaaaaaagaattgtatcttttttatttttatttttatttttttgagacagagtctcgctctgttgcccaggctggagtgcagcagtgtgatctcagctcactgcaacctctgcctcccaggttcaagcaattctcctgcctcagccttccgagtagctggaataacagatgcccgtcgccacacctaggtaattttcgtatttttagtagagatggcgtttcgccatgttggccaggctagtctcgaactcctgacctcaagtgatccacctgtctcggcctcccaaagtgctgggattacaggcgtgagccaccatgcccagcagaaatacacctttttaaaggtgaagagatatgaaagcttggggtccacagggcctcagagatattttctcaccaaaattagaaaaaaaaatgcacactactagaagtttcaaagtcagagcaactaagtgaaatacacctgtcactaaaagacaaatactgtacgatcccacttattagaggaacttaaatcatacatagaggtagaatggtagctatcagtgactgggggaaggggaaatggggaataattgatgtatagtttcagtttcacgagatgaaaagagtttttgagatgaattgtagtgatagttgcacaatattataaatgtattcaatactactaaactatacactttaaaataattaaggccaagcatggtggctcatgcctataaacccagagttttcgaaggctgaggtgggaggattgcttgagtccaggaattcaagaccagcctgggcaatatagggagatcctgtctctacaaaaaataaaaattagccggatacagcaccatgggcctatagtcccagctactcaggaagctggagcaggagggttgcttgagcctgggaggtcgaggctacagtggagctatgaatttgtcactgcactccagtctgggtaacagagtaaaatcctgtattaaaaaaaaaaaatgacatagcaaattttatgttatgtgtattttaccacaataaaaaaaaaagaaggaaaaaaatcaacaaaaataaagtcattcagtcatttgacatttaataaatataaacccagacccaatgcagtggctcacacatgtaatcccagcactttgggaggctgaggtgggaagatcgcctcatcccaggagtttgagaccagcctgggcaacacgacgagaccctgtctctacataaataaaattattttaaattaaaatagaaatatagtaaataggaacccaaaagcatataattgtttgaaaatccattatttagaaactataatagaaaactatgaggccaggtgtggtggctcacgcctgtaatcccagtactttgggaggccgaggcgggtggatcacaaggtcaagagattgagaccatcctggcaaacatggtgaaacgctgtccctactaaaaatacaaaaattagctgggcgtggtggcacgtgcctgtaatcccagctacttgggaggctgaggcaggaaaactgcttaagcccgggaggctgaggttgcagtgagccaagattgcaccactgcactccattctggtgacagtaggagactgcgtctcaaaaaaaaaaaaaaaaaaaaacaaatcaaaacaaacaaacaaaaaactatgattgaaaaacagatgaatttgtaatattttcataagacagtatcaattcataaagaagtgaatactaaattttatgactttttcaagcactagagaacagactcaaagagtttagtttagctccagttgtgtcaaagctggtatctcacagctggcagcacactgccaatctgtctaaagaggacgcaaaccagcaacttacagcagaaaggatgggcaacaataccactgggagctgagacgccaagaggccaacataagaaatggccactgaaagagggaacaagtaaggaaagaagggagggagaaacagccggattaaaaagggtagatgagggagaagggaaggttgtgattatcgggcacttctcagaaagacaccatgaaatatgggctaagtcctgtgtggctgaaccccacagaggacacagatgatggcaaacgacaggggctgcaggaactagggacctaacatttgggatttacgcagggggtgtcattgaaacttcttttttttttttcctgtgagacaagagtctcactctgttgcccaggctgcagtgcagtgtcacgatgtctgctcaccgcaacctgcgtctcccaggttcaagtgattctcatgtctcagtctcctgagtagctgggattataggtgtgagccactgcacccggctaatttttgtatttttagtagagatcgggttttgccatgttggccaggctggtctcgaactcctagtctcaagtgatccacctgtcccaaagtgctgggattacaggtgtcagccactgtgcccaacctgaaagtttttaagcaggaaaagaagtgatcaaatttgcgctattaaaaataattcttatttattttttattttatttagtttttaagggtctcactatgttgcccaggctagtctcaaactcctaggctcaagcaatcctcctacatgggcctcccaaggtgctgtgattacaggcgtgagccacatctcctggcctaaaaacaattcttaaaaactaaattcttacagcagtttggaagagggcctgggaagggagatagaaggaccggctgtaagaaaagtcttagtatgtggtgttgtatacctgaagtcccagctacttgaaagggcaaggccagaggatcattatgactgcacccctgcactccagcctgggtgacagagcaggaccccaactcaaaaaaaagaaaaagtccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaagtctgatggagtgatacgtggggatctcgcagtcagccacattagtgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgagattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagatattccctttttccttcaaaattcccctcacatctctcgaaactgtcttgagacatgctcttttaacaaatagcattattcaaaaaaggagagactatactgaagcatggaattctgccttccccatttgctgtcccttaatctgggtcttacttccatcaagtaaggtagaaataattttaacatgtgtctgacatggcacagggtagtcacatgaatccaattcagtaaattatgtaaaagtactttgtgaacagcagagctctataaaaagtagtaatgggctgggtatggtggttcacggctgtaatcctagcactttgagagaccaaggcaggcgttcccttgagcctaggagttccggaccagcctgggcaacatggcaaaaccccatctctacaaaaaatacacaagttagtgggcgttgtggagggtgcctatagtcctagctacttgggaggctgaggtgggaggatcacttgagcccagaaggttgaagctgcggtgagccatgatcatgccgctgcactccagcctgggtggcagagtgagactctctctccaaaaaaaaaaaaaaaaaaaaaaaaaaaaaaaaaaaaaagtagtaacagtagtattactacattctttaatattatctacatacttaatgtcattaaaaaaaaatgtccagccaggtgtggtggctcatgcatgtaatcctagcactctggaaggaagaaatgggtggatcacttgaggtcaggagttcaagacaagcctggccaccatggtgaaaccctgtctctactaaaaatacaaaaattagctgagcatgctggtgtgtgcctgtaatcccagctacttgggaggctgaggcaagagaattgcttgaacccaggaggcagggcctgcagtgagccgagactacaccactgcgctccaacctgggcaacagagccagactctatctcagaaaaagaaaagaaatatccaccattagtacttccacctgaaaagaacttttacaagttaaagtgcaaaaattctgatggcaggtatataggggtctgtaagttattttctgtacttttctctctaaataaaatatttgaaaattaaatgtacttttctctatatataaaatatttgaaaattaaattttaagaaacttaaatgaaaacagaaaataaatgcttcctaaaagcttggcactctaggtccatccatgacaacagagttagtatcagcatccttaatatcacgagaagtcactgtgagcctgttctccaagtattacgtcaaaatattcttcggaaaggtgaagcccaccttcaaagtagtgaaaggcagatcctccaggggaactgggagggggcatgccgcgttcagggctgacctgaaacacacaaccacagttacatatcagaaaagaccagtgagacctccatcagatttgtcttagacaaggtcctctctgccagcccaatgtttgtacttcaagttctggttgaagcctcatttccttcctaaagcccatcacagctacagcattctctactacatgctatatcactaaattctttgtgtttagccgtatatttgacacttgattactgagctgaattgtcctcagtgttttgtgtttttgtcttttctccatgagtcaattatatacttcttaagggcaccaactgtcttccaggcaaaatagcatttggcacccaactgctatgaaacatatactttatgactatgaaatcacttataaatcttatgttggggactagcctcaacaccacctgtagggtatttgatgtttggtggcgacaaaggaatgagaagaaacaggttaagagtttataaaggcgggagccaggggaccagagcaaatcagaggccgcaaaggcctagagttttggtttttacactatttattgagtataatcacttagatttaagaagcagatgtttagggcgaaacggtgaaagggaggcagtgtgtcatatgtgtaatctatagtagcggcagtttaaatgaattttttttgtgtttaaacagtatattttcaacttattggacagcagttagtgggagcaggcttaactaggagtctgtatgtttggccatattttcatgttttaaaggagtggtttttttttttttaacacagtgtttatggataagagagtaagtcttgctcagagtatgggaacataatggcgataaggctttttttttagaggccttttgtggctttttacacctcattgttttatatttttatggccagtttatatgtgcactctataagcccttccccccaacatcttaagagggacaagacaagtctttgtattaaagagaattctagtgaaacatttcacgttacttaagtttactccaactacaaagaagagggattttcttcgcaggggagcttaacagggtctttctcctctgctctttccccagtagcccaggcccacctgagagatgctggacacactgctggttttcctcttcagggtaccctcctgacagacagtcagcagattgctggggaggatggagcggaagtcattaaaggaacgccttcgaacaccttcaagctcttccaggacacggagggaatgaggagggattttgggaaagagctttgagaggagagactcttccatgttgctgtaacgcccaaatgctcgcgagattcctatcaggcatgggatagcatacttgcaaaggtattctagaagatcaagtgaaaacgttacaatataagaaagtatcctgatagagtcatatagtaagtactaacttgtaacattgactaagatttcacaacccacccactaataactgtgaaggttcacaataagccacaataatggggtccaccccaagggctgacaagtgatatcttcaacctgtcattaacaacttcagactatgacttcaatacacccagctgccctgcttggaaggtcttcatctattcatggcacacccaaatcaataaaatagctaggccatattatcaagtaccttatacatttattcctcttaggagcatattggtagcctcacaacacagaaaaaatgacctttggaagtcaactaatctacccacagatgttacaggtgaagaaactggggcccagaagggtgaagttacttgtccaaggtgacccagcgtctatgtagcagagcaatgcacatgaccccatgtggcctctgaggatactaacacacaacaaatcaaactaaaataggaaggttttctcccatcatatatattaggtacccaacaacagaaaagactggagaaaagcaagggaaagagtaaccacaaaaccattttaagaaaaaccttaaggatactcgtacctttgtcttgaatctccaaggcctggcacatccccaagaggacatgcaaaacctgcaaaagcacctctaaaatctgtaacagtcaaggaaacaagaaaaaaaaaacataaacaaaattaggtaaatatcacgaaactaagtcagaattagaaggcacttcagacattatcttaaccaaccccatatatgatacatccctccacaacgactgtgccaagtggccaaccagctgactttccagggacaaaaccctcactctctgggctggttccgagttcctcccaatactgggccaatgttgtcctcctggggcttgtacctaccagcccttggggctgctttttcctctattaacatattctgtaaacaggtgatgggtccccaaatcttctcttttcatgggtaaacgccctagcgcttttcaaccgtattcttcatgatcataaatcctttgtaatgctaattgccagcttctgattttacggtagtccagttttctgtctggaagtgtagtgctcagaataaaatacattaacatctgggatgctggaactcacccagcatactcaccaaactcatcacagattctacacttctatgtatgtgacattagcttttctgcagccacttcacactgcttatgtgaagctcatctcaatgagcttatacataatttttaaattttttttatttgtttgagacgaagtttcgctcttgttgcccaggctggagtgcagtggcatgatcttggcttactgcaacctccacctcccaggttcaagcgattctcctgactcagtctcctgagtagctaagattacaggtgcatgccaccatgcctggctaattttttgtatttttagtacagacagggtttcaccatgttagccgggctggtctcgaactcctgacctcaggtgatccacctgccttggcctcgcaaagtgctgagattataggcgtgagccactgcgcccagtccataattatttaagttaagaaatttttttttgttcctggaagggtggcttatgcctataatcccagcacttttgtttgtttgtttgttttgaggcgcggtttcactcttgttgcccaggctgcagtgcaatggcatgtctcggctcaccacaacctccgcctcctgggttcaagcgattctcctgcctcagcctccttagcagctgggattgcaggcatgcaccaccacgcctggctaattttttatttttagtagagacggggtttctccatgttggttagtctggtctcaaactcccaacctcaggtgatcgatccacccacctcggcctcccaaggtactgggattataggcatgagccactgtgcccagccaatcccagcactttgggaggctgaagcgggtggatcagttgagctcaggagttcagacctgcctgggcaaagtagcaaaaccctgtctctacaaaacatacaaaaattagccaggtgtggtggtgcgtgcctgtggtcaggaggctgacgtgtgagggtcacttgagcccaggaggccgaggatatagtgagccaagaacagtgcaggggttcaatgatagctcactgtagcctcaaactcctggactcaagcaatcctcctgcctcagcctcctaagtagctgggattacaggcatgtgtcactatgcccagctaatttttatttttatttttgtagggataggttttgctatgctgcccaagctagtctcaaattcccgggctcaagtgatcctcctgcctcagcctcccagaatgttgggattacaggcgtgagccaccatccatgacaataagcttatagatgaggaagatacctaagtcttctttcgcacctgcttctcctgaactatgtaatctctactaacgtagttggtattttttatctttcatctacccctacaaaaactcatggtattagctttagctcactgtacaaatctgtgattcccagctttgtgccttctccaaatgaaatcaacttgctttccagatcttcattcacagcactagcttgttttgctccaatgacaggagggtcctgctaggccgatacctcactgatcaccctttgggacagtccttcaggcagttctgcaaaccctccaaaccatttggccctcagcccatataactggtccaggatgtcaggaaaggtgcttgtccaaagcatttatgaagatccactagaatgcagcaacttcatttctctcaaccattcttcttagaaaacccaggcaaagaaaaaatgaagttggtgtgacatgacttgttcataaccaagtcaaatctcttacattttcctaatattaagtaatgctgaataatctacaaaagcttgaaaagcaatagtttttccattttatttatttattttgagaccgagtctcactctgttatccaggctggagtgcaatggcatgatctcagctcactgcaacctctgcctcccaggttcaagtgattctcatgcctcagcctcccgagtagctaggattacaggctcctgccaccacgcccggctaatttttatatttttagtagagatggggtttcttcatgttggccaggctggtctcaaactcctgacctcaggtgatccacccgcctcagcatcccaaagtgctaggattacaagcctgagccaccgcacccagccactttttccattttatatgttaaagtcatgttatcacctttggtgttgacctctttattctgataaattttattcatagaaaaaagcccttaatgtccaactttttaataaaaacacattattctaacatatttaagtatttctttagccaacctacaaataaatgaagaatctaaattagtcaaaatacatcactaactgggaacatttagaatgcagacaagcaactaggcactgtttggaagaacctaggaacagcagcatacaaaaactaactttctaagcgataaatttaagaaaaagttgtatgattacattctttgtttaaagaacaggaaagtatgaaatacatgtttgtaacatttctatcaaaattaacaaaatctaaagaaagtctgtgcccttaaagataaaagcttcagctacctagaagattctcttctagctgggcacagtggctcacacctataatcccagcactctgggaggtcgaggcagaaggatcacttgaggcccggagttcaagaccagcctgggcaacatggcgaaaccttgtctctacaaaaaatacaaaacaaattagctggcatgatggtgcacgcctatagtctcagctacttgggagtcttaggagggaggctggcttgaggtggacggcagaggttgcagtgagccaagattgcaccactgcactccagcctggatgacagagcaagactgcctcaaaaaaagaaaagaaaatgatcttctatgaatgacttcaatccccaacaaagagcaagaaaaatgagctgcctctgcctttttctgccgcctaccttaaaggactttctgaaaagctgaaagggatagtgctgctcatgtctctgcagcccctgcccttcattagaaaaaagaaaaaaaaaaaaagaaaagtttaataagataagactcgagatcctaaagagtagtgaaagacctaagcatgtcttaggtctgctgtcaacaggatgaaatagataaatatcaacaaacaattcaatcacatttcacgtttttaaaatcttttcatcactttgggactctattcaatctaatagaaatgcataccaaatcaaccaacacatgcttacctcatccctaagtgaaggatccctataggccacatcagacagcagagttaccaagcagaagctgaagctctctgcaaccgggagggcacctggaagatgtaaaaacataaatcagataaccaggaaccagatactgggtcacacctctggccatccaattcaatatgttccctctcaccatgacctgccaagggaccagtttacagcagctgccctccttgagacgagtctcaaaagaacagctatgggcccaatgagtttgctgagaaacacccttacctttcctttaagtaaatgttttggttcaataaacttaaatgtttcctgagccaatagctagtgtgagataacaaagcctctcaacatgacagattcaattttttattccctaagtaaatgtgataaatcacacacacacacacacacacacacacacacacacacacacacacacaaaacactcggctgggcgaagtggctcaagtctgtaatcccagcacttttggggggccaaggcagacggatcacctgaggtcgagttcaagaccagcctggccaacatggtgaaaccccgtctctactaaaaatacaaaaattagctgggtgtggtggcgcacacctgtaatcccagccacttgggaggctgagacaggagaatagctcgaagccaggaagtggaggttccagtgagccgagatcgcaccactgtactccagcctgggtgacagaatgagacgccatctcaaaaaaaaaaaaaaaaatcaattttgaatattgaatgttgaatcaaggaaaaaagagtatccactatttaatagctatattcatagtacatgacagaagacttacatttctactccagcacttaaaattttaaagtgcagctctaggctgttctcaaacttgaatgtgcccatgcccggcctaaaatttgaccttttagtaatgatgctctatttaatttgtagtccatcaaattgcaggacagactgggtgcagtggctcatgcctatagtcctagcactttaggaggccaaagcaggcagatcacttgaggccaggagttcaagaccagcccagccaacatggcaaaatactatctctaccgaaaatacaaaaattagccaggcatggtgatgcatgcctgtaatcccaggtacttgggaggctgaggcacgagaattgcttgaacccaggaggtggaggttgcagtgaaccgaggtcaggccactgcactacagcttggagtgcagacagagtgagactgtctcaaaaaaacaaaaaacaaacaaaatcctaacaaattgcaggtacatgcataatttgggatctgtcagttttaggcatgttaccagaaatgatgaaaacccaaaggttaagaggaatactggcacaaacagaatgttttttaatttttatttcaggttcaggggtacatacgcagttttgttatacaggtaaactgcatgttacgggggtttggtgtacagattatttcatcatccccgtaataagcatagtacccagaaagtagttttcccatcctcaccttcctcctattctccactcttaagtaggccccagtgtctgctgttcccttctgtgttcatatgtactcgaagtttagctcccacttacaagtgagaacatgcagcgtttggtttcctgttgctgtgctaattctcccataacggtctccagctccatccatgttgctacaaaagacgtgatcttggccaggtatggtggcctcacacttgtaatcccagcactttgggaggctgaggcaggcaaataacttgaggccaggagttcgagaccagcctagccaacacggcaaaactccatctccactataaatataaaaattagccgggtgtagtggcacatgcctataatcccagctacttgggaggctgagacaggagaatcgctcgaacctgggaggcgagggttgcagtgagcagagatcgcaccactgcactccaagctgggtgacagagcgagatcgtctcaaaaaaagataaaataaaataaaaaataaaaggacataatctttttctttttttatggctacacagtactccacggtacacatacgacattttctttatccagtcttccactgatgggcatttaggttgattccttatctttgttattgtgaatactgctgtaataaacatacttacgcatgcatctttacagtagaatgatttacattcctttgagtatatacccaataatgggattgctgggtcaaatggtaatcctgttttaaattctttcagaaattgccaaactgcattccacaatggctgaactaatttacattcacaccagcagtgtgtaagtgttcccttttctctacaacctcaccagcatctgttatttcttgactttttaataatagccattctgactggtgtgagatggtatctcattgcaattttgatttgcatttctctgattattagcatcagatgatgagcatatttttcatatatttttggccacttgtatgtcttcttttgagaagtatctattcgtccttggctcaccttttaacggggttttttttttgtttgtaaatttaagttcctcatagattctggactttagacctttgcatagtttgcaaatattttctttcattcagtagggtggctgtttactctcttgacagtttattttactgtgcagaagctctttagtttaattaggtcccatttgtcaatttttgtttttgctgcaattgcttttggcatctttgtcattaaatttttgccattaaatctttgccagggtctatgtccagagtggtatttcctagtatcttccagggtgtttatagtttaaggttttacatctagatctttaatccatcttcagttgatttttgtataaggtgtaagtaaggggtctagttccaatcttccgaatatagctagccagttatcctagcgccatttattgagcagggagtcctttccccattacttgttttgttgactctgttgaagatcagatggttccaggtgtgcagcattatttctgggctctctattctatttgtctatgtgctattttttttaccagtaccatgctgttttggttactgtagccctgtagtagaggtgaagtttgaagttgggtaatgtgatgtctccagctttactctttttcagactaccttagttattcaggctcttttttggttccataaaaattttaaaatagtttttttctaattctgtgaagaatgtcattggtagtttgataggaatagcactgaatccataaattgctctgggtagtatggccatgttaacaatattgattcttcctatctatgagcatgggatgtttttccatttgtttgtgtaagctctgatttctttcagcagtattttgtaattcttgctatagagatttttcacctccctggttagctgtattccaaggtattttatcttttcttttttttgagatggagtctcactctgtcgcccaggctggagggcagtggcacaatcgcggctcactgcaacctccgcctcccaggttcaagcgattctcctgcctcagcctcccaagtagctgggattacaggcgtgcactaccatgcccagctaatttttgtgtttttagcagagatgggtttcaccatgttggccaggctggtgtcgaactcctgacctcaagtgatccacctgcctcggcctcccaaagtgctgggattacagtcgtgagccactatgcccgactggtattttattatttttgtgaatattgtgaatgggactgtgttcttgatttggctctcagcttggatgttgttggtgtataggaatgcttctgatttttgtacattgattttgtatcctgaaactttgctgaagttgtttatcagatcaaggggctttgggcagagactatagggttttctaggtataaaatcatataatctatgaaaagagatcgtttgacttcctctcttcctatctggatgccttttatttctttctcttgcctgattgctctggccaggacttccagaactatgctggataggagaggtgagagagggcatctttgtcttgttctggttttcaaggggaatgcttcgagcttttgaccatacagtataatgatggctatgggtttgtcatagatggctattattactttgaagtatgttccttcaatgcctagagtttgttgtggatttttttggggtttttttttgagacagagtcttgctctgttgccagattggagtgcggtggcgtgatctcggctcactgcaacctctgcctcccgggttcaagcgattctcctgcctcagcctcccgagtagctgggactacagatgcctgccaccatgcctggctaattttttgtatttcaggagagacaggatttcaccatgttggccaggatggtctcaatctcctgacctcgtaatccgcccacctcggcctcccaaagtgctgggattacaggcgtgagccaccacgcctggcctgttgaggatttttaacatgaagggatattgaattttatgaaaagcctcttctgtatctattaagataatcacatggtttttgtttttagttctgtttctgccatgaatcacattaattgatttgcatacattgtatcgatcctgtatcccagggataaagcctacttgacctggtggattagcattttgatgtgctgctagattcagttacctagtattttgttgaggatgtttgcatctatgttcatctattggcctgaagttttctttttttgttgtgtctctgccaggttttggtatcagcatgatgctaccctcatagaattagggaggagtccctcctccttaattttttgtaatagtttcagtaggagtggtaccagctcttctttatgcatctggtagaattcagctgtgaatccatctggtcctaggctttcttcagctggcagactttttactactgactcaatttcggaacttgttatttgtctgttcagggattcaatttcttctgggtttagtcttggtaggttgtatatgtccaggaatttatccatttcttctaggttttctggcttgtaggcatagaggtgtttgtctctctgggttgggtttttttattattattatttctgtggagtcactggtaatgtcccctttatcaatttctggttgtgtctatttggaccttttctctttttttctttgtaagtctagctagtgatctttttttttttattcaaaaaaccaactcctggatttgttgatcttctgtatggttttcatatctcatttccttcagctcagctttggttttagttatttcttatcttctgctagctttggggttagtttgttcttatttctttagttcctctagttgtgatgttaggttgttaatttgagatctaacttttcaacgtcagcattcatgctataaacttccctcttaattctgccttagctgtgtcccagagattctggtatgttgtatcttcattctcattaatttcaaataatttcttgatttctgccttaatttcatcatttacccgaaggtcattcaggagcaggttatttaattttcatgtaattatatgctttcagtgattttcttagtatttaattctatttttattgtgctgtggccctatgagttcagtttttctgaatttgctgaggcttgttttatgtcttatagtgtggttgattttagagtatgttgcatgtgcagatgagaagaatgtatattctgctgctttcgagtggagtgttctgtagatatctattaggtccatttggtcaagtgtcgagtttaaatcctgaatatctttaacagttttctgccctgatgatctgtctaacactgtcagtggggtgttgaagtgtcccagttattatgtggttacctaagcctcttcataggtctctaagaacttgctttatgaatgtggttgcttccgtgttcgatatgtataaatttgctcccgtgttggatatagtcaaatcttgctgaatcaagccttttaccattatgtaatgcctttctttgtcttttgtgatcttcgttggttggaagtctattttgtctgaaatcagaatagcaatccctgctcttttttccattttccatttgcttggcagatttttttcatccttttactttgaatgtatgggtgtcactgtatgtgggattggtctcttaaagacagcataccattgggtcttgcttctttatccaatttgccacaatgtgtcttttaaagggatatttagtccatttacattcataatattgatatgtgtggctctgttcctgtcaccatattgttagctggttattatgtaggcttgtttgtgtggttgctttatagtgtcactagtctaggtacttaggtgtgttttgttattgttgttgtttgttctttttttgagacagagtttcattcctgttgcccaggctggagtgcagtgatgcgactgtggctcactgtaacctccacctcctgggttcaagtgattctcctgcctcagcctcctgagtagctgggactacaggcatctgccaccatgctcagctaattttttgtctttttagtggaaacggggtttcaccatgttggccagcctggtctcaaactcctgacctcaggtgttccatccgccttagactcccaaagtgctgggattacaggtgtgagctactgtgcccagcccttaggtgtgtttctgtagtggttggtaataatctttcccttccatgtttagcattcccttcaagaccctgtaaggcaggtggtggtaaagaaatcccttagcatgtgcttgtctcaaaaagatcttatttctccttcactcataaagcttagtttgaccggatatgaaattcttcgttgcaaattcttttctttaacaatgctgaatatgagccaggcccagaggctcatgcctgcaatcccagcacctttgtgaggctgaggagtgggggtcacttgaggccaggagttcaagaccagcctagtcaacatggcaaaaccctgtctctactaaaaatacaaaaattagctgggcatggtggtgtgtgcctgtagtccccagttactcaggaggctgaggcatgagaattgcttgaacctgggaggcggaggttgtagtgacccaagatcgcaccactgcactccagcctgagtgatggagtgagactctttctcaaaacacaaacaaaaacaaaaacaaaaacaaaaacaaaaacaaaaacaaaacaaaacaaaaaggctgaatgtaggcctccattctcttctggcttgtagagtttctgctaaaaggtctgctgttagcctggtgggactccctttgaaggtgacctgtcccttctctctagctgcctttaacattttttttctttcatttagaccttggagaatctgatgactatgtgccttggggatggtcttcttgtgtagtatttcataggggttctctgcatttcctgaatttgaattttggcctctctagtgagattgggaaaatactcatggataatatcctgaaatacgttttccaagttgcttattttctctctccctatctttcagggacaccaatgagttgtatatttggtctctacataatcccatatttctcagaggtgttcattctttattttctttatttttgtctgagttattttggagagctggtctttgagctctgggattctttcctcagtttggtcaattctgttgtttattttgaaattctttttttttttttttttgagatggagtcttgctctgttgcccaggctggagtgcagtggcgcgatctcggctcactgttgcctctgcctcccgggttcaagcgattctcctgtctcagcctcccaagtagctgggatttacaggcgtgcgccaccacacccagccgatttttgtatttttggtaaagatggggtttcatcaccttggcaaggctggtcttgaactcctgaccttgtgatccacctgccttggcctcccaaagtgttgggattacaggtatgagccactgcgcccagccgaaattcttgaagtgagtttttcagctccatcagctcagtttggttgttttctttttgagacggagtctcactctgttacccaggctgaagtgcagtggcatgatctcagctcactgcaacctctacctcccaggttcaagcgattctcctgcctcagccacgcaagtagctgggattataggaacctgccaccacacctggctaattttttgtatttttagtagagatggggtttcaccatgttggccaagctggtctcgaactcctgacctcaagtgatctacccaccttggcctcccaaagtgcagagattacaggtgtgagccactgtgcccggccggttttttcttaaaatggccatttcatcttacatctcctatatcgttttattgtatcctttacagtctttggattgggtttcaactttctcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccagccaaagcactctgtcggatagtggcagcctatttgcttgtgacagcagcaccagcagtgcaatggggtgcatgctcattggctgaggcagggtgctaggaggcctggggctgcctgcctctatgtgggcattggcagtagcagtggtgcacggccgctggggtctgtgtgcacatttgcaccaatggcagtggtagcacagagttagagctggtgacctctgtgcatgcgttcatgcctgtggcggtggtgttgcggggcccagaatgttaatgagaacagcaaaacccatctttagcagactgggacatgttgcccagactagttttggtttgtttttgtttttttttttttttttttttgagacggagtctcgtgctgtcgcccaggctggagtgcagtagcatatctcggctcactgcaacctctgcctcctgggttcaagcaattcttctgcctcagcctcccgagtagctgggactacaggcacacaccaccatgcccggctaatttttgtacttttagtagagatagagtttcaccatattggccaggctggtcttgaactcctgacctcgtgatacacccgcctcggcctcccaaagtgctgggattacaggtatgagccaccacgcccggccgacccagactagtcttaaactcctgagttcaaacaatctgcccacctcggcctcccagagtgctagaattacaggagtgagccaccataccagccaatttattccgtttctaaaggtgcaaagtttaactggaacttagaaacaaagtgatgaaactatttacagtgaacattgctgttgggtctccaacctccatctcaccctttttgagcagcagcaatataatctggaaaactgacctcactccaggagtgagcctataaattctaagggtaacagtgactgatttggggacgggcagatgacccaattctggccaatgagacatgagaaaaggttcttgaaggtctcaacgttcttgctcactctcagaagaatgcaatggaaagctggcctacccaggcctaccttctccccaactcatccatgggctgtggccaacacatggatgtaagctcagcccacaatgctgcaggcagttgtttcccagccaggagggagacaagatgcatctgatgtgtcagtatgaataaacacttgatcctacagacactgaacatgtgtattttctcttatattcagggaaaacattatatacaattacctctgcctttccgagctgtgctttcttctacccaatacacttttggaagacctttgagaagtcgaagaaggtaaggaaccacacaatctttgtgctaaaaaataataagaagaataataaattagatttaataaaataagtgattggcagctttttagcccagattaagcccaaagcaaagcatatccacatcctaatcatctcagagattctccagggataatgtaaagtgcatgtaaattcacatggcatcactccattcctgttttcacactgcagagtccagaggctgtcctatcaacctgtaccacaggagcctaaggaagggttcgcacctgccttctggagctgagggtccagcctgctcaggcctcttctgggggctgggcctctccaggaggtacacgtgtgtacacactcaaagctgtcttcagtgagaatggtttagagccccaaaacccatccatgagccccagaataagatcctggggatggagagaagctcacaatgcgggcatctcaactgggtgatgcttttttctgttcatgtcccttgtccattttccttgtgttttttttttttaattttctacttcatgtttcctcttgttcttctcaagttgagcatcagactttatagccaactttagcccagtgaaaaattttactttcctctaatttctgaactagccaatcaacaccaatatatagcttcgtaatcttccatcattggcttttggagctatttccctatttacagatgttccagttaaggattagatgtgctccagagaagaagtgtgctctagagaagaggagtactatttgatgttttgaaatgctgacaaaccacatggtagttttaaaaacatggctgcagccaggcatagtggctcatagtggctcacacccgtaatcccagcactttgggagacccaggcaggtgaatcacttgagctcaggaatttgagacccagctggccaacatggcaaaaccctgtctctactaaaaatacaagtattagctgggtgcagtgggacgtgcctgtagtcccagctacttgggaggctggggtgggaggatcgcttgagcatgggaggtgaagactgcagtaagtcaagattgtgccactgcactccagcctgcgcaagagagtgaaatcctgtctcgaaaaaaattaaaacataaaagcatggcagaaggtggccgggtgcggtggctcacacctgtaatcccagcactttgggaggctgaggcaggcggatcacgaggtcaggagatcgagaccatcctggccaatatggtgaaaccccttctctactaaaaatacaaaaaattagccaggcatggtggtgggcacctgtagtctcagctacttgggaggctgaggcatgataatggcataagtaaacccaggaggcggagcttgcagtgagcctagatggcaccactgcactccagcctgggcgacagagagagactccatttcaaaaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaatcaaacaaaatgatgtattaagcactaagtctggggggactttgttataccataatagataactaaaaacaaagaactttatcaaaaacaaaagttttttctctaaaccataaaaaggaactggctaagacatctgtcgaggatcctagtgtacagacaggaacaaaactccataaggcctgaaccacatggcctcctgcagaggaagtggctccaggtggctctttcctatataaactgtgatgacattagcagcacagggtgagtaaaaccacctcagctcctctggccacagctgctaccatggcagcccactgctgggacctgaaggaggtcaatgcacagcccatcctggagggaagcaaggaatataagcaccaggtaaaaaccaaggtggtccctagggctttctcagggggctggcaaagcatgctaggcttctctcctagtatatgcaaggccggtgggctgccctggacatacaggcaaactctatggtccaagggacaacatcacatgccacctgggaccctgctagtccttacccagaacctgaatgacacttgtgctcatctatttgttgtcatcttaagaagtctaatacaagtacaacactttcaggacttacaggtaaatctatcaagaaacgtgtttgccaaagatattatcaagtaatccacatttgaacaacaatagtttcttataaatttttttaaaattattttttgccctttataattcattttatatttatgtaggatatggtaaacagaaaaaaaaaatggttttctttcttttcacatttataaataaacaggcaagctgggtatggtggcacatgcctgtaatcccagcactttgggaggcctaggcacgaggatcacttgagaccagggttggagatcaacctgggcaacctagcaagaccctcatttctacagaaaattaaaaaatcatgccaatgcctataatcccagctgctcaggaggctgagatgggagaatcccttgagcccaggagttcaaggctgcattaaataatgactgtgccactgcactccagcctaggcgatagagtgacactctaagaataaataaataaatagcagaagaaaggccaaaatgtagcttatgtatctaattttggttttttatgtaaccttgatcaggtaacctatttaattattaaaatactgctctataattaaaattcttatttgtttccaatgtacaaatactgttaaaatattaatgcttattagagcaaaatttccaggagatggaagcaacctgttctagataaatattcaaatatctaacatctttatttacctaacacagcataattaacttggaatttagaaatagtatctagtaatgataaaaataaataaataaataaaagattcaatatccaatgatcaatcatttgtttcaaatagctttggtaaatataaaaatacacatacacaacagtcacactatttttttgttggagctacagggctagattttaagtccctattaaaaggtacactgaggccaggcatgatggctcacacgtggttcacgcctgtaatcctaacactttgggaggcagaggcaggcggattacctgaggtcaggagtttgagaccagcctgcccaacatggagaaaccccgtctctactaaaaatacaaaaaaattagccaggagtggtggctggtgcctgtaatcccagctactcaggaggctgaggcaggagaatcacttgaaccctggaggcagaggttgcagtgagccgagattgcaccactgcactccagcctgggtgacaaagcaagactccatctcaaaaaaaaaaaaaacaagatacactgatacatactctaaaagtttatatacataatcgcaattttgaaaaagatgatattatatcaaaattacctaaaatgattttgtccttttggaaggagaaatacaatacccctgagtctgactgataagcattttacctgagcttgaaaaccaaacctaccctggaaggcacacaattacttctcaaagcattttaacttactctgtggcacataataacaaacaaacaaaaatacactttttttacaacataatatatgcacacaattctaaaaaactcaaattttctaagaaggtttacattaggaagtttcattcccaccttgtcctaccctctccactaaccactttgattaggttcaaatgtattcttctactattgctttaggtaaatataagcagatacaaacttaaacgctcactacacccccttttacaatgaagaaacttttaatttcatgaagacttacctgaagatcagattcaatcagaaaaatgcccaatgcaatcactgcatctctccgtctttcatctaactggaagatcccatggaaatccactggacacatgcaaagaagcttttggacctagaaaatgagacccccccaaaaacagctctacaaaatagaaaaccacattcaaaataaagcaagctgagtgcagtgtcatatgcctgcagtaccagctattcaggaggctgaggtgggaggataacttgagttgggagtttgagactagcctggccaacatagtgagaccctatctcttaaataaataaaaataaaaaataggccaggtgcagtggctcacacctgtaatcccaaccctttgggaggccaatacaggtggatcacctgaggtcaggagttcaagaccagcctggccaacatggtgaaaccccatctctactaaaaatacaaaaattagccaggcgtggtggcgcacacctatcgtcccagctacttgggaggctgaggcagaagtatcacttgaacccaggagacagaggttgtagtgagccaagatcgtgccactgcactccagcctgggtgacacaacaagactctgtctcaaaaacaaacaaacaaacaaaaccactaccataaaccccaaagagtccatgtaaccaataagtcatagttttttttcagttaaaagatcacaggacatctccagctgctgaaacaattgtacacgtgcccctcaaaacacataaactctgagtaatatgagctgaaggttaaaactgtgtatactcagagggggtaagacacaatggctaaagtttgcattttggtgttaggacagtctaagtgggtgtccccaccccttgaccacgaacaggttacccaaaccaacctgcattaacaatgcctcactgactcttttaaaaaatcaaatgcatggccaggagcggtggctcacgcctgtaatcccagcactttggtaggccgaggcaggcggatcacgaggtcagaagtttgagaccagcttggccaatacggtgaaaccccgtctctactagaaatacaaaatgtagccaggcatggtggcgagcggctgtaatcccagctactcaggaggctgaggcaggagaattgcttgaacccggaaggcggaggttgcagagagccgagatggcaccactgcactctccagcctgggcgacagagcaagactccgtctcaaaaaaaaaaatcaaatgtgtgaagcagttgggactgagcacagcatatagtaaatgctcaataaacattatctattgttattggatatactataatagtggctagtggaaggcaaaagcagacaatgagattcaaagaatgctgattaatgagtcaatcactgaagcacagggaagaactggccctatcaaagcctatgtactttgctctgtcctatgcaatactttatcaataccctgcactaaaacacagaagatacattccactacaaacctggcagatgaaactaatgtgctagaagacagcacgaagacttgaaaactcatcaaaattggcataacatcattatttctccaacaatagtgcctgaaagacaacttttgataatgtgatcagggagggcctctctaagatggttccttaaattgggatctgatcaagaaggaagccaggacaaatcaggaaaggctgctgctgcagcagcacagtggaaaagaagaagcaaggaggcccaggagttcaggtccagacagagaaggtccccagagggccccacaggccaggtcagaagcctgaattgtatcctaataacaaacacatagaggccttagggcatcaagtttagaactgaagtctagaagaatccctctggctgatacacagaaaatggattttggaggacaagagtgaaaacagagacaggtgaggagactcctgcagcagctgaggagactcctgcagcagctgaggcgaagatgttagcatggtagcaatcaacgagtagagacagaaacagaccagttcaggatgtgttttgaaggaagagttaagaggacttgatgatggacaggatatgggagagattactttagttgcctctttaccacactagaaagtatccaggccaggtgcaaggctcatgcctgtaatcccagcactttggaaggccgaggcaggaggatcacttgagcccaggagtttgagaccagcctgggcaacacagtaagaccctgtccctacaaaaaaataacaaaattaatcagctattgtcagaggcgtgtgaaccagagcaactccatcctgaataggggctgggtaaaatgaggctgagacctactgggctacattcccaggcagttcaggcattctaagtcacagggtgagacaggaagtcaacacaagatacaagtcataaagaccttgctgataaaacaggctgcagtaaagaagccagctaaaacccaccaaaaccaagatgtctggtctcgaactccttatctcaggtgatacgcccacctcggcctcccagagcgctgagattacaggcatgagccatcgcaccctgccaccaaggctttcttttttacataaagcataagaatggatttcctctctcaggccaggtgctctgggttgggctctaacaatatcccaggatcagaattcagcatcatcaacacagtttagccatactgccagtgcagcggtcaccccacccagtagaaagaactgaaggcagcattttttaccatcctcaattcctctggactgccagggcctcctctctttcaaatgcccagaggggctctggggtactctgacttcagaccttcctcccctatccccactcaactaaaaacatttaaatagaaataatctgtgaccattcagaaattactttaaaagccaggcatagctttaaatgtgaagtgaagataccaaaaagaacaactcagagatccatgtaatgattccatgatttatgcactacactggcatgtcaggcagaataatggcacctcaaagatgtccacaccctcaatcccctggaagctgtgaatatgttactttacatggcaaaagagaccttccagatctaattaaattaagaaccttgaaatggagggatatcctggattatttagataggcccagggcaatcacaaaggtcattaaaaggagaagagagaggcagaagagggagtcagagtgatgtgagatgggggcttggccaaccattgctccctttgaaaatgaaggaaggggccagaaatcaaggaatgtgggcagctctaggagctgtaaaaggcttggaaatgatggctgggtgcggtggctcatacctgtaattccagcactttgggaggctgaagtgggtggatcacctgaggttaggagttcaagactagcctagccaacattgtgaaaccccatctctactaaaaatacaaaaattagccgggcatggtggcaggccccgtggcaggtgcctgtagtcccagctactcgggatgctgaggcaggagaattgcttgaacccgggaggcagaggttgcagtgagctgagattgcgccactgcactccagcctgggcaacagagcaagactccatctcaatatatacatattaaaaaaaaatgaaaaaggcttggaaatgagttctcccctagagtctctaaaaagatacacagccctgccatcaccttgatttcagtccagtgaaacacaggttgtgtttctaatctacagaactgtaaaattataaacgtgttattctaacaacaagtctgtggcaatttatttacagtagtaataggaaactaatgtaattggtcactggtaattaaacaaaactcaaagcctactggactgcctatcaagaaaagtatcaaactgagtaatcagattacaggcaataggccgggcaccgtggctcacacctgtaatcccagcactttgggaggttgaggtgggcggatcacatgaggccaggagttcgagactatcctggccaacatggcaaaactccatctctactaaaaatacaaaaatcagccaggtgtggtggcctgggcctataatcccagctactcgggaggctgaggcacaagaattgcttgaacccaggagccggagatagcagtgagccgagattgtgccactgcactctccagcctgggccacagagcaagactctgtctcaaaaaaaaaaaaaaggccgggcgcagtggctcacgcctgtaatcccagcactttgggaggccgaggtgggcggatcacgagatcaggagatcgagaccacagtgaaaccccgtctctactaaaaatacaaaaaattagccaggcgtggcggcatgcgtctatagtcccagctacttgggaggctgaggcaggagaatggcgtgaacccgggaggcagagcttgtagtgagccgagactgcgccactgcactccagcctgggcgacagagcgagactccgtctcaaaaaaaaaaaaaaaaaattacagacaatatttagttccttctttattattttctgtatttcccatattttctataaaaaatattgataactttagaatcagaaaaaaatacggccaggcatgggcttacgcttgtaatcccagcaatttggaaggctgaggcaggagggctgcttgagcccaggagttcaagaccaggctgggcaacatggcaagaccctgtctctacaaaaaatttaataattagccaggcacggtggcatgcccctgtagtcctagatgctcggggatccgaggagggaagattgctagaggatcgcttgagcctagcaggttaaggctgcagtgagctgtgatcacactactacactccagcttgggtggcaaagcaagaccctatctccaaacaaaaaaagaaaaagaaaagaaatacagaatataccgaagttcatgtgctgcactgatatgcttacctgaactgcaggcctaaggatcactgacaactcccaaacatatgaagaagtgtaggtctaaggtcaggagaggttgcacagatgcaaccagcaaacgttcactttcaggcaggccatgtgttatcctattcctgttttacaggttaggcaactaggtccagataagttaagtgcacctgaggcaacaggttcctaactacatcttccttctcattttgtctcttcctactccaatatttccacttctggttcatataccttcaatggttccccattgcccaatgaacactcagtgcacactcccagccccaaaacttctctcataaacccaggccgctatgtatcaattctcatttctccctgcctggcctcttccatggttttgacccatctgaaacattttgtccaacctgccctatctcccctataaaaattcaacccatccttccaagatccatctcaactgtctcaaaactctcaaacattttccagaccccagcaacttgatgtaatatctcccatcatatctctcaatagctcacatagaactctgtatttctcaagataattaccttcctgatgtcttacagttacttgtatacttatcctctcactgcagagaggcctgtgacctcctcatcactccactgcaccctacacatttcagaactttaacaactacttaatgggactaaagcggccaaggtcacagacatttgataaggtgaggaggaaagaaaagaggtacagggctactagaaagcagggtttaactacactgtgataattgtcatatagtcagtaccaggcacagtgctggcatgcagttgacactgaacaagtatctgctgccttactgaatgaatggagggacggatggaagaactctcaaatgaagtaatatataatgtacagtcactccctcatgagcgttacaatccagcaggagttacaaaactaataaaaataatacaactagcaaataacacaagtcagaaactaaacgacagagggccctgaaagcctggagcaaaatgctcttggaaactgggactcttattagaaagacatctgaaaacttgaacctgggtcctacagaaaccatcacacccagttctggtgggtgccattctccaaataatgacagctaacacatattgaacatttatcatgtgttcatctatattatcttatttaatcctcacaacagctcattaggtagctattattaatcatcccccttttacatatgatgaaacagacacagagaggtcaaagtcctaatgcaggataaagcattaaccctctagtctttgaaaaaatgaaaagaaaaataacatcaaatggcttttcagaatcagaattttacaataaactagcaagttgtttgtttttaggggtcttagggggagtgggtcattataaaaagtcattaagcccaaaatctgaccacgatggccagggttattcccatttacaaaaaggatccagagggcttctacccaccactttcaaaaggttgttaagtcaatggaccacagggaggcaacaaatatgactgacttagactttgataagaactcttggcaatactttaacccaaggatattaaaagacaggtatctcaaagatgtgaattttgactgccaaggtaaggaaatgctaaaccaaggagaaaataagattcaaggagaaagtaagtctggatgactgggcagaaaattgcagatgagaatcaaccataacagagggtatttgtaaggtatttaggtcaaaataaagctacaataatagcattataaaagttggataattaaatgatttttttaaaagagtactacttgttatttaaaacctctgggaattgtcttcctggagaaacaaaattctctgagaacaaaagactaagatttaagtattaatggtatatttttctgttaaaaccatttgtaattgtctttctcaaatgtaccatcccctcagacaaaaaatattgaatataagctgatattttcgaagtgactcagagctatcatgataaacaaaggtgactgtgacatgatacacatggacctacaaatgtaaatggaacagcacctgatcctacaagcaccctggatcagagtttcattagagatgcgcttttgagctgagcgcggtgggaagtgcctgtaatcccagctgcttgggaagctgaggtgggagtactgcttgagcctaggagttagaggctgcagtaagctatgatcgtgccactgcactccagcctgggcaacagagcagaatcctgtctccaaaaatacaaaataaaaaagatgctctttggtcatctgtagacagattcatgaccttctaacaaacaaattcagcaaggttacaggacacaagattaagatacgaaaatcagccgggcgctgtggctcacgcctgtaatcccaacactttgggaggccgaggcgggcggatcaggaggtcaggagattgagacaccatcctggccaacacagtgaaaccctgcctctactaaaaaaaaatacaaaaaaattaggcaggcttggtggcgggtgcctgtagtcccagctacttgggaggctgaggcaggagaatggcatgaacccgggaggcagagcttgcagtgagccaagatcgcgccactgcactccagcctgggcaacagaacaagactctatctcaaaaaaaaaaaaaaaaaaaagaaaagaagaaaagaaaataaattgtatttctacaacgcagcaatgagcaaattaagaaaactattccatggttaattttatgttatatgaactttatctcaattattaaaaaaaaataataaagaaaaacactaacgcaggaacagaaaaccaaatactgcacgttctcaattataagtgggagctgaatgatgagaacacaggaacacacagtggggggaacaacgcacgctggggcctgtgaggtgggggagggagaatatcaggaaaaatagctgtcaggcacagtggcccatgcctgtaatcccagcactttgggaggccaaggcgggtggatcactttaggtcaggagttcaagatcagcctggtcaatatggtgaaaccccatctctactaaaaatacaaaaattagccaggcgtgggggcaagcgtctgtagtcccagctaatcaggaggctgaggcaagagaatcactagaacctgggaagcagagattgcagtgaactgagatcaccacagtgcattccagcatgggcaatagtgcaggctcaaaaaaaaaaaaaaaaaaaaaagggtggggggccaggtgcggtggctcatgcctgtaatcccagcactttgggaagccgaagtgggtggatcatgagatcaggagttcgagaccagcctgaccaacatgatgaaaccccgtctctactaaaaatacaaaaaaattagctgggtgtggtgcaacgcgcctgtaatcccagccactcagaaggctgaggcaggagaatcacttgaaccgaggaggtggaggttgcagtgagccgagatcacgccactgcactccagactgggcaacagagcaagactccatctcaaaaaaaaaaaaaaaaagtaatagctaatggatgctgggcttaatacacaggtgatgagaagatctgtgcagcaaaccaccatggcacacatttaacaaacctgcacatcctgcacatgaacctaaaataaaagttgaagaaaaatgaataaataaaaatgtaaaaagaaaaacaactgtaataatcccagcactttgggaggccaaggcaggaggattgcttgaacccaggagtttgagaccagtctgggcaacatagtgagtctctaaaaaaaattttagaaattaaccaggaggctgggtgcagtggctcacgcctgtaatctcaacactttgggaggctgaggcgggtggatctcttgagcccaggaattcaagaccagcctggggtacatggtgaaacccaagaccaacctggagtacatggtgaaacccagtttctacaaaaactagccaggccatggtggcttgtgcctgtagtcccagctacttcagagactgaggtgggaggactgcttaagcctgggaggtccaggctatagtaagctgtgataataccactgcataccactgctctccagcctgagtgatagtgagaccctgtttcaaaaaaaaaaacaaaaaaaaccagtagaacaatttcatttaaaatagcatcaaaaagaaaaagtacttatgaataaaaacaaaagaagtgcaaaactaagaaacattacaacattgctaaaagtaaagaaaacctaaataaatggaaagacatcccatgttcatagatcaaaacagttactattgtttagatggcaatacaggccgagcacagtggctcacgcctataatcccagaactttgaggggccagggtgggtggatcacctgaggtcaagagttcgagaccagcctggccaacatggcaaaaccctgtctctgctaaaaatacaaaaattagccgggcatggttgtgcacacctgtagtcccagctacctgggaggcagaggcaggagaattgcttgaacccaggaggcggaggttgcagtgagctgagattgtgccactgcactccagcctgggtgacagagcgagactccatctcaaaaaaaaaaaaaaaaaaaaaaagggacaatatagcaatacagtccaaactaacctacaaattcaacaccatccctgtcaaaaccctaggtgagttctttgcagaaactaacatgctaaccctaaaatttccatggtaattcaagggacccagaataacaaaaacaatcttgaaaaggaaggacaaaattggaggactcattcttcccaatttcaaaacttactacaaagctaaagtaatcaagacagtatactagccaacatcaggaaagacatacagaccaaataaaccctcacacttacagtcaactgatttttgacaagggttccaggacccctcaatggaaaaaagaatagtctttccaagaaatcgtgctgagacaactggatattcacatgcaaaagaatgaaactggacccccatctcatatcacataaaatcttaactcaaaatggatcaaaaactcaaatgtaagagctaaactataaaactgctaacaaaaaacacaggtgtaagtctttgtgaccttgaaattagacagtggtttcttagatacaacacaaaaagcacaagggacaaaagaaaaaaaaaatgacaaaatggacatcatcaaaatttaaaacttttgtacttcaaagaacaccatgaagaaagtgaaaaagcccacagaatgggagaaaatatttgcaaatcatatatcttattaagaaacttttatctaaaataaagaactattacaacttaattaaaaaaatactacaatttaaaattgggcaaagaatctgaatagatatatctccaaagaagatctacaaataccccaaaagagtggctgttctaggatagaataggctggctcaacatcattaaccatcaggcaaatgcatatcaacaacagaataataagatcccacttcacatccactaggatggctataactggaaagacagacaatacagagtgttggtgacaatgtaaagaaaacaagccctctgtacaccgttggtgggaatgtaaatggtgtagtaactttggaaaacagtctggagttcctctaaaggttaaacctagagttattgtatggcccagcaattccacatctagttaaagacccaagagaaatgaaaatatgtctacagaaacacttgtacgtgaatttccatagcagcgttatttataatagtcaaaatgtagaaacaatccaaacatccacctactaatgaatggataaaatatggtatatgcatacaaatattatttagtaataaaaatgaagtaatgagatgctacaacatggatgaaccttgaaaatacgccaagtaaaaaccatcatggcaggtgcagtggctcacacctgtaatcccagcactttgggaggccgaggcaggtggatcacaacaaggtcaggagatcaagaccatccggctaacacgatgaaaccctgcctctactaaaaatacaaaaaattagccgggcgcagtggcgggcgcctgtagtcccagctactcgggagtctgaggcagaagaatggtgtgaacctgggaggcagagcttgcagtgagccgagatcgcgccactgcactctagcctgggctccagagcgaaactctgtctcaaaaaaaaataaaaataaaaataagccaccacaaaaaaccacatcttatagaattctatttctacaaaatgttcagaataaatctacagagacagaaagtaaactagtggttgtctagggatggggctggtagggctgcagggtaacagcaaggtttcttttgagggcaatgaaaatgacctaaaattgatcatggtgatggatggacaactctgtgaatacactaaatatgatgaactgtacattttaaatgggtaaattttgtggtatgtgaattatatctcaagaaagcactattgaaaaacctagcctatgaaggatcaaatcaaaccacaagcaactgccgaccagaacaaagcccaacattccctaaagtaacacaacaaaaatctaaacactcaagccaggcacggtggctcgcctgttaacaccagcactttgggaggccaaggcaggtggatcacttgaggccaggagttcaagactagcctggaaccccgtctctactaaaatacaaaaaattagctgactgtggtggcgcatgctaaaggagtccccataggtctctgggactataaatactcatttaaaaaaaaatttttttttttgagacggtgtcttgctctgtcacccaggctggagtgcagtggcgtgatctcagctcactgcaagctccgcctcccaggttcatgccattctcctgcctcagcctccccagtagctgggactacaggccaccacgcccagctaattttttgtatttttagtagagacggggtttcaccgtgttagccaggatggtctggatttcctgacctcgtgatccgcccgcctcggcctcccaaagtgctgggattacaggtgtgagccaccgcgcccggcctactaaaattttttaaaattttcgctgggtacagtgactcaagcctataatctcagcactttgagaggctgaggtgagtggatcacttgagcccacggtttgagctaagcctgggcaagatagtaagaccccatctctaaaaaaatttttctttttttacttagccaggtacaatgtgcgtgcctgtagtcccaactacttgggaggctgaggcaggaggatccctcaaaccaaggaattcaaggtggtagtaagttatgatcatgccactgcactccagcctgagtgaaaaagcaaaactgtctccaaaaaaatgtaatttctatttttaaaaatgtctaggccaggcacagtggctcatgcctataatcccagcactttgcgaggccgaagtgggcagacggcttgagccctggaatttgagaccagcttgggcaacacagtgagaccctatctattttttttttaatgtctatttatccacccctctaataccagggcctagcacagtgcctgcaacacagcaaacccccaaagatttatcatatgaacggatggtgccatcttttgctttcataatagtatagccttgggttttttttgttgttgttgttgttttttgtgtgacggagtcttgctctgtcgcccaggctggagtgccgtggtgcaatctcagctcaccacaccacctcccgggttcaagcaattctcctgtcttagcctcccaagtagctgggcttacaggcgcacaccaccacgccctgctaatttttgtatttttagtagagacagggttgcaccatgttggccaggctggtctcgaactcctgacctcaggtgatgtgcctgcctcagcctcccaaagtgctgggattacaggcgtgagccactgtgcccggctgcgttggttatcctgaatccaggcttccagataagctttaaacacagaaaaacattcaggaaaagagaatggcttctgcagcagagacagagcctctcaggactcaataaacaaatgcaagtgagacctgaggatttctgcctcaactctgtatttatttgtcagtttaccacacaaatgaaagtagcgttctggccaacttggcaatgttcatgaaaggccaagcttttctccagcatgccaacatatacaacaaaagcaaatacaaaaataaaaatataaataagccatcctggctaacacagtgaaaccctgtctctactaaaaatacaaaaaattagccgggcgtggtggcgggcgcctgtagtcccagctactcgggaggctgaagcaggagaatggcatgaacccaggaggcagagcttgcagtgagcagagatcacgccactgcactccagcctgggtgacagagcaagactccatctcaaaaagtaaataaataaataaacaaataagcaatcaggaagataaaatgcataaatttcagcaactgacgtcaatgatggaaatagctgctggtgggaaagattagaggcaaccacacctccaatgagtgcaaactgcaaacacagacagcagaaaagagaatctgcagtaaggagtgagaaatagaacatttctgccccctggggagacaaacagctggtgacacaggagggcactgagggaaggctacgtgaaggcagagggagaaagtggcctcggaagaaatcaacattgctgacaccttcatcttgaacttctaacttccagaatgaggaggaaatatatctgtgttgtttaagccagtctgtggtactttgttatggcagcctagcaaactaatagttaatatggcatggttacaggtaaagattttttcttcttccaatttcttcttaaaatattttctagttgatttaataacaatgattctggcaccgcgtataccctccgctgaccctcattatctctctcctctcgctctacggatggctcttcttaacatagcctcacaaagcaaagggaaagaggataggaaattcttggcttcatgatactggaaaaacgccaacactatgatttttactccatggcagaccactctaaagtacagactgaataaccatgaactccagaaagcccactaccctaagcaccaagccacatattctcccaactacagattagaattaactcatcttatggagcacatatgtccaccaaggagggttcagcctgtccctaatgccgcagtgccatttaaacatcagatcgggctgggtgcagcagctcacacctgtaatcccagcactttgggcggccaagaaaagagaatcacttgagcccagaaatctgagaccagcctgggcaaaatggtgagactccgtctctattttctttcaaaaaccagatcaatagttagctacgacacctcaggattctggcattctaactgaagaaaacaaagagaacattttaggacatggaaaaagggctctgatcaaagcctcctgagggtggggagaggaatagaaggacaaggaatgctatctactttgcagctctgcccatgactctcggtatcccaggatcgagggcccactggtttaatacaggcctatagaggagagacacaaacaggccactgaacttccctgacaaaggaagattaaccaggcagggccaggaggaagcttagtaggggtggctcagcaacattctgaagacaggtgagaaccaggaaagcagaacaagactagcgggcagatagaaatcaggaaggaggagtctggaagccaactgtatatggagatcccaatgttgaaaagcctcactttctttcttgcctatttttttcttcttatctttctcccagagggagagggctgaggactgggtaggatttggttcaaagggcttcacagacagagtgtcctctgaggtgggttccaatcctgggggtgggaccccagtctaaagcacagcctagcaggaaaagctcaaagctcagccatggatcagaacagatgctcaagggtcttggctttggctatgggaacatggcaggagtctagtcaccagacctgaaatatgagagtagaatgggatcttggtcaggttggggtagctcacacctgtaatcccagcactttgggaggcgaaggcaggaggatcccttaagccctggaatttgagaccagcttgggcaagatggtgagacccccatctctaattaaataaaaaaaaaaaagtagatgggatttatggtatttcattggttcattaaaggaaagagaaaaaaaaaaaagagtagacgggaaacttgtagcaaggctgacttgctgctgttcacctgagcaatcaaattaacactgcttctgatttacctggggcctagcacataccaaggagcagcaggagctcaataaatgttttctgaaagtaattttgttttttttgagacagagtctccgtttgtcgcccaagccagaatgcagtggtgagatctcggcttactgcaacctcagcctcctgggttccagtgattctctggcctcagcctcccaagtagctgggattacaggcgtccgccaccacgcctggctaatttttgtatttttagtagagacggggtttcaccatgttggccaggctggtctcaaactcctgacctcaagcgatcagcctgcctcagcctcccaaagtgctgggattacaggcgtgagtcactgtgcccagcctaaggtaatttttttttttaagtaaagtccacagagcagtaataggcttggtttcatggactgggattagagtgagtgactagagtaagtaaacacaactgtggcatgtagagagacaaaggtagggaaggttatgtcattaatgtacctcaagtgtcactaaaaccatgtcagggctgcctgagttaccaatgtctgagctgagatgtgaggtctggttctgcaaacttagccttcgccaggtcaaccctatctagatcaagccccacgcagtcctccaatctctcaggaagaaagaagagaaaaaaatagaagcaaagagaaggggaagagggaagagagaaggggagggattgggttttaaatactcatctccccctataagtctccatctttattatctcaggtgcgtactctaaaattcctttactcttaagaacaagaaacttggccgggcgtggtggctcacgcctgcaatcctggcactttgggaggccgaggtgggcggatcacctgaggtcaggagtttgagaccagcctggccaacacggcgaaaccccatctctactaaaaatacaaaaattagctgggtgtggtggcaggtgcctgtagtcccagctactcaggagactgaggcaggagaatcgcttgaacccgggaggtggaggttgcagtgaaccgagatcatgccactgcactccagcctgggcaacaagagtgaaactgtctcaaaaaaaaaaaaaaaagaacaagaaacttttccttgggaatgctaagggctttttgtcaattgcttcaaaaggaggaatgtagtaaaacacatattataggactacatattttatatatatatatttttattatactttaagttcaagggtacatgtgcacaacatgcaggtttgttacatatgtatacatgtgccagggactacatattaacaatgatccctagcataatcaagtcgcaagatcttagataaggatgagaggaattcacatatatttaatggggtcagccacttacagaagcctcctctatgaaataaggtgcttcaggggtccccagactgcccacatgtatatagttgtactcatggctaaattttttacagtgaatggatatcagcaataggaaaggacctcaagtgtcactaaaagcatgtcagggctgcctgtagaaacccatgcacaggcttccttatgttctctccctcctgtgaggatatacatcaagcttgctccttgctacagcagcaaaatattcaatacatgtgtgcagtttgtgcccaggaaagtccattagagaatcagcaccctaagtttttaatttatgcaccaccagcctagccatcagattcccagaaggaaagcaggtattcaacataaatcatagtttgtaaaaaggatctaggcatagtgaaccatctttattactaatagttacaggattgaggaaagcattcaagtgcttatttcccagatgccagccaaaggccaactttgtaagcaggctcttgtaaaaacagcagccccagtgctgctctattcactcttcttcacagaagtgattagtaatagctaggcacagtggctcatgcctgtaatcccggcactttgggagaccaaggcgggtggattacttgaagtcaggagttcaagaccagcctggccaatagggtgaaaccccgtctccactaaatactaaatactaaaccccgtctctactaaatactaaaaaatttgcccggggtggtggcacacgcctgtagtcccagctactcaggaggctacagtggaaaaatagcttgaaactgagaggcagaggttgcagtgagccgagatctcaccactgcactccagcctgggcaacagagcgagactccctctcaaaaaaaccaaaaaagtgattggtaaatgttgccaatgagactgaagtacttcctaaagtaagtggcattagggagctgccaacctgtggctatggctgtgttccttgtaaaatataatctttttcttttttttttttttttgagacagttttgctcttgtcacccaggctgaagtgcaatggcgcaatcttggctcactgcaacctctgcctctcaggttcaagcgattctcctgcctcagcctcccaagtagctgggattagaggcacgtgccaccacacctggctaatgttgggtttttagcagagacagggtttcaccatgttggccaggctggtctcaaactccgacctcaagtgatctgcctgtctcagcctcccaaagtgctgggattacaggcatgagccaccgtgccccatcataaaatataatcttgacaactgaagcagttattactacaaagctaagaatgttgcaattacagaatgttctcgtgactagtgaacatggctgaagaagcaaattgagctcaaggtgcccttttctgagttactgagtggaaagggtgctaccactgctggagctgcaggaccagcttcttaaagatcatccaattcactgcattctcttctctctcctcccagaatccagcaatcagtcataagatatatttgttggctctcctgctaagaagcgaatgtgctgactagctagcatgagtttgattcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtcccactctaaaatctgtctctttccagatctcaaggcacaccactgagttgcctttcacctttctcccaagatgaggattgctctggcatgacttcacctttctcttctgaagcaattccaagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcggaagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccttcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgcccgacctcagggcgcaggcgtaggtgcatccggctttcccgccacgtgacctctcagttgctgacactagatagggcgtggctgcggggcgggcccaccgctgcaggggagagaggggatggacagtaggctgcggttgcgcgcgccggatgtgggccccccccagccgacctgcgcgatggtcggctccgagggcggggccacctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttctctttaacctctttttgtgaatatgtaattttaagtgtacactataccaatttagtaataatcttatactttgcccatatgggccttttctgcagattttttttttttttttttttttttgagatagagtctcactcagtcacccagcctggagtgcagtggcacaatctcggctcactgcaacctccgcctcccaggttcaagcaattctgcctcagcctgtcgagtagctggggttacaggtgtgcaccaccatgcccggctaatttttttatttttttaatacagacagggtttcactgtgctggccaggctggtctccaactcctgaccttgtgatctgcccgcctcagcctcccaaagtgctgggattacacgtgacctgtagaattttaaagttacaaatgttgttcagcatcttcagctctgatgaatgcggtgtcagtacaaaatgatgagctagagccagggcatggtggctcatgccaataatcccagtgctttgggaggctgaggcaggagaatctcctgaggccaggagtttgagaccagtctggacaacatagtgagaccccacctctagaaaaaatttttaaaaatagcttggcctctagtcccagctactttggaggctaaggtgggagaattgcttgagctcaggaatttgaggctgcagtgagttatgatcatgccactgcactctggcctgggcaacagagggagaccctgtctctaaaaaataataaaatgatgagctaagttcgagaccagcctggccaacacagtgaaacgctgtctctattaaaaatacaaaaattagccaggcatggtggcatgtgcctatagtcccagctactcaggagactgaggcacgagaatcacctgaacccggaaggcagaggttgcagtgagccgagaccacaccactgcactccagcctgggtgacagagcgaaattccatattaaaaaaaattgatgagctagtcattaaaagtgctcattatggctgggcatggtgactcgcctgtaatcccagcactttgggaggccgaggcaggcagatcatgaggtcagaagatcaagaccatcctggctaacacggtgaaaccccgtttctactaaaaatacaaaaaattagctgggcgcagtggcgggcagctgtagtcccagctactcgggaggctgaggaaggagaatggcgtgaacccgggaggcggagcttgcagtgagccgagattgtgccattgcactctagcctgggtgacagagtgagactccgtctcaaaaaaaaaaaaaaaaaaggaaaaaaaaaagtgctcattatgtggggatgggatgggctctttagttcgaactgtttcagaacagcacttttcctccatgccttcaactcaacaagtgaccatattccatcaaaatgtgaagttgtttttttaaacaaattttgtctcctgtgtagttatttcttagtgagttggtggaggggatcttcctcgttgagtcttcatgcatttggtctttgatgccacgtttagccctatgaactaccttctgtcctgaaaccctctcatcagttttccggtgtgtctcctagctccctacccgctctgcagcactatctagaccagggctcagcaaatttctgtaaagggccggagagtcagtgtttcaggcttacaggccaaaccatctctatctctattgcagctgctcagctctgccattgttgcataaaagcagccaaagatccgggcgcagtggctcacgcctgtaatcccagcactttggaaggccgaggcgggtggatcacttggggtcaggagtttgagaacagcctggccaacctggtgaaaccctgtctctactaaaaatgcagaaattagccaatcatggtggggtgcacctgtagtaccagctacttgggaggctgaggcaagagaatcacttgaacccaggaggcagaggttgcagtgagccgagattgtatcactgcactccagcctgggcgacagagtgagtttcaaaaaataaagaataaaagcagccaaagacaatacgtaaataagtgagagtgcgcgagagtggctgtgttccaaagctttatttatggagactgaaatttcacataattcacatgtgataaaatgctatgaattttttttgtttttgagacagcatcttattgtagaatcaaaaggtctgagaaagcatctgtaggttaggctaggccattttggaattttttttttaattaattttttttttttttgagatggagtctcactctgtcttccaggctggagtgcactggtgcaatctcagctcactgcaacctctgcctcccacattcaagcgattctcctgcctcagcctcccaagtagctgagattacaggcgcccaccaccacgcccagataattttttgtaactttagtagagacagggtttcaccatgttggccagggtggtctcaaactcctggcctcgtgatctgcccacctcagcctcccaaagtgctgggattacaggtgtgagccacggagtctggcccatcttggaaatttttatctgtcagtgggctagctccccgtgtcccaaaagccactgtggttttagtggaatatcatctttatttatttatttatttatttatttatttatttatttattttttatttttttgagacagagtcttgctctgtcgcccaggctggagtgcaatggcgcgatctcggctcactgcaacctccaccttacgggttcaagtgattctcctgcctcagcctcctgagtagctgggattacaggtgcatgccaccaagcctgactaattttttgtatttttagtagagacggggtttcaccctgttagctaggatgatctcgatcacctgacctggtgatctgcccgcctcggcctcccaaagtgcagggattacagacgtgagccactgtgcccggccaaatatcatctttaaatatcatcattataaataaggaatgatgaggatttgaacccaggcagtggacttttctggggagacaaagaagtggacattacaagctggatgcggtggctcacgcctataatcccagcactttgggaggctgaggtgggtggatcacctgaggtcaggagttcgagaccagcctggccaacattgtgaaacctcgtctctactaaaaatacaaaaattagctgggcgtggtggtaggcatctgtaatcccagctactcaagaggctgaagcaggagaatctcttgaacccaggaggcggaggttgcagtgaaccgagatcgcaccactgcactccagcctgggtgacagagcgagactccatctcaaaaaaaaaaaaaaaaaagaagaggacattacagaggaagaagcataagtgaaaaaaatcaaggcggctcacatttggcatctgcaagtagggaactggcgttatgggttgtgggtgggagatgacatgaaaggtaggcaggatctaatctaagaggccttatgagccatactgaggagtcagaatattgcacttcaatgacagggaggtactgatggagtctaagcaagcgagtgacgtgacaagattcagattttgaaagatcataaagatgcatcaccgcattatttataaaagcaaataatggctggacgcggcggctcttgactgtaatcccagcactttgggaagccaaggcaggcagatctcctcaggtcaggagtttgagaccagcctggccaacatggcaaaaccctgtctccactaagaatacaaaaattggccaggcgtggtggcagacacctgtaatcccagctactcgggaagccaaggcaggagaatcgcttgaacccgggaagcaaaggttgcagtgagccaagatcacaccactgtgctccagcctgggtgacagagcaagactctggctcaaaataaataaatataaatataaataaataaaagcaaataataagcctagaaacaacctgattaggaagatgatggagtcaactatgttcacccatagctgcaacagacaattgcatctatgaaaagtcttcaaagataatgcttgcaagattaacataaaacattatatggtatggtcccaactttgtggaaaagcaaaccaatatatgaatttcaaacaaaaaaaaatcactcttgcatcagtgaggaggacaagctgggaacagagtaaggaaaagactttggtcatggtccaagcaagaattgaagaggggcccaaactagagtggtggcaggacagaaagggagagatggggcagactgcagagcactgggtaggacaggctttagtgaccaactcaccaatgtaggatgacgtagaaggaggaagcgaagatagcactcaggcttctgggcaaaggaattagtagacagtgtttttcacaaaaggaatacaaaaacaggccaggcgtggtggctcacacctgtaatcccagcactttgggaggccaagatcaatgggtgggtgaatcacatgaggccaggagcttgagaccaccctgggcaatatggtgaaaccctgtctctattaaaaatacaaaaaattacccacgttggtggcgagcacctgtagtcccagcttctcgggaggctgaggcatgagaattgcttgaacccaggagatggaggttgcagtgagccaagattgaccacgcaccccagcctgggcaacagaacaagactctgtctcaaaaaaacaaacaaacaaataaacaacaacaaaaaaaacatggctgggcatggcagctcacacctgtaatcccagcactttgggaggcagaggcaggaggattgcttgagtccacgtgtttgagaccagcctgggcaacatagtgagaccctgtctttacaaataataaaaaattagccaggcattgtggtgcatgcctgtgttcccagctactagagaggctgagacaggagaactgcttgagcccaggaagtcaaggctgcagtgagccatgaccatgccacttgggcaagagagtgtgaccctgtctcaaaaaaaaaaaaaaaaaaaaagcacaagcaagtttggggttagggacattgatgaactaggtactggacaggttaagtttgaagacctttgggacatccagatggatcccaggtgctgcaccaaaagttatgcacaaaacagatcagaatccctgccctcatggaatggacagagaagacaatgaataagacaagtagaaaattaataggctgggcgcggtggctcacgcctgtaatcccagcactttgggaggccgaggcgggcagatcacgaggtcaggagatcgagaccatcctggctaacacggagaaaccccgcctctactaaaaatacaaaaaattagccgggcgtggtggtgggcacctgtggtcccagctactcgggaggctgaggtgggagaatcgcatgaacccaggaggcagagcttgcagtgagccgagatcgcgccactgcactctagtctgggcaacagcgagactccatctcaaaaaaaaaaaaaaaagaaagaaaattaataggccaggccaggtgtggtggttcaggcctgtaatcccagcactttgggaggccgaggcaggtggatcacctgaggtcaggcgttcaagaccagcctgaccaacatggtgaaactctctctctactaaatataaaaaaattaactgggcatggtggtgcatgcctgtaatcccagctactcaagaggctgaggcaggagaatcgcttgaacccgggaggcagaggttgtactgagctgggatcatgccgttgcactccgacctgggcaacaagagcgaaactccatctcaaaaaaaaaggaaagaaaacaggccaggcgcagtggttcacgcctgtcatcccagcagttcgggaggccgaggcaggcagattacctgaggtcaggagttcgagactaacctggccaacatggtgaaaccccctctctactaaaaaatacaaaaattacaaaacaatttaaaaaactacaaaaattaggctgggtgtggtggctcacgcctgtaatgccagcactttgggaggccgaggtgggtagatcacctaaggtcacgagtttgagaccaatttggccaacgtggcaaaatttgtctccactaaaagtacaaaaattaaccaggcgtgctggtgggtgcctgtaatcccagctactccaggggctgaggcaggagaatcgcttgaacccgggtggcagagattgcagtgagccaagattgccccacttcactctagcctgggcaaaagagcaaaactccatctcaaaaaaaaaataaataaataaaaatacaaaatacaaaaattagccaggcatggtagtgggtgcctattaattccagctacttgggaggctgaagcaggagaatcgcttgaacccaggaggcagaggttgaagtgagccgggactgtgacattgcactccagcgtgggtgacaagggcaaaactccctctcaaaaaaaaaaaaaaagagaaaagaaaattaatagaatattaaatgtgaccatggtgaagtatttgcatatgacctatgtacattctcctgtatactttttgttgttgtttgttttgttttgtttttgagacagtctcactctgtcacccaggctggaatgcagtggctcgatctcggctcactgccacctcggcctcccaggttcaagcaattcttgtgtcttagcctcctgagtagctgggattacaggcatgccacgcctggttttttttttttttttttttttttttttgcgacagagtcttgctctgtcacccaggctggggtgcaatagcacaatctcagctcactgcaacctccacctcgcaggtttaagcgattcccctgcctcagcatcccaaatagctggggttacaggcacctgccaccacgcccagctaattttttgtatttttagtagagacagggtttcaccatgttggccaggctggtcttgaactcccgacctcaggtgatctgcccgcctcagcctcccaaagtactgggattatagacatgagccactgcacccagccatatacatattttgagacagtgtctcactctgctacccaggctggagttctgtggtgggatcacggctcactgcagcctcaacctctcaggcataagtgatcctcccaccacagcctcctaaatagctgggattatagacatgtgccaccacacccaactgatttttttattttttgtagagatggggttggccaggctgctctgaaattcctgagctcaagtgatcagcctgccttggcttcccaaagtactgagattataggcatgaaccactgcgcccagtctagaaatttattttctcacagttctagaggaaccaaagtgttgggtcccttctgagagtggtgagagaaagatctgttctgggtctctccctggcttgtacagggcagtcttctccctgtatctttatatcatcttaaggacaccagttatactggattagggcccaccccaaagaccttactttcagtaattacctttgttaagaccctatctccaaataaggtcatattctaaggtactggggattagaacatccacatatgaatttggcaggggagtcaggggagcacagttcaacccagaacctatacaaataagtttcagctggaaggagctgacatctgacggcctttcttttctttatttattttttattttttctgagacggagtctcgctctgttgcccaggctggaatgcaggggagcggtctcagctcactgcaagctccacctcccgggttcatgccattctcctgcctcagcctcctgagtagctgggacaaccggtgcccgccaccacgcccggctaattttttgtatttttagtagagatggggtttcaccgtgttagccaggatggtctcaatctcctgatcttgtgatccacccgcctcagcctcccaaagcgctgggattacaggcatgagccactgcacctggcctggcctttattttctttgcgtggctgaaattggatggagcagagatagatgactggagagttagatcaccaaggatagggctgtcatagacccagctaagacagggcacttagaaggaccctggtctttaacacatttcatggatttaaagaaatagagtagcagtttctagccttagagtcactagttagcttcgcagctgcttagcagcaggtagtagaggacctcaccaatacggctgaagttcaagagcaggactcctgaaccaggccctctgtcttgcacctataatcccaggtactcgggaggctaaagcgagaacacttgaggccaggagtctgggaccagcatgggtaacacagcaagcactggccccctacacttcttagaaaattaaatttttttttggagacggagtttcattcttgtgacccagcctggagtgcaatggcgcaatcttggctcactgcaacctccacctcccaagttcaagcaattctcctgcctcagcctcccgagtagctggaattacaggcgcacgccaccacacccggctaatttttgtattattagtagagaaagggtttcaccatgttggccaagctgctcttgaactcctgacctcaggtgatccacccgccttggcctcccaaagtgctgggattataggagtgaactactgtgcccagctaaaaattaaattttaaaaagatcaagcctcctgtccctgggctgaccagacagccaagaaaggcaagttagaaatcagggctctggcttaaggcttagggcaaaggtctggttccctgactacggtcacaaggcagaagtctaggtgccagacccagggctcaaatcagagaaaaagtaaagctgacttgacattgatctttgcatttaagtgctttaaatattccccaaaaaatgtcccaaaatccggataggacttgacttgactgacacttgcttagttgcccatgctggattgcagtgatgtaatcatggctcactgcagcctcgacctcccaggcataagcgatcctcccacctcagcttcctgagtagctggggccacaagcacatgccaccacgtcctgctaattttcttttttttttttttttagaccaggtctcgctgtgttgtgcaagctgatcttgaactcctaggctcaaatcatcctcccacctctgcctttcaaagtgctgggattccaggtgtgagccactccacccagccaggacttgaccatagactaaaagcaaaagagtgaggcaagccatttataaataggaaagaaactgctcacccgacccccaccaatgctgaaggaagcacaacaacaccctaaagaagatacaaaccttggagacaaagagcacctctaggtcatttagaaattaaaccaagctgggcatggtggctcacgcctgtaatcccagcactttgggaggctgaggcaggcggatcacgaggtcaagagatcgagaccatcctggccaatatggtgaaactccatctctactaaaaatacaaaaattaggccgggcgcggtggctcacgcctgtagtcccagctactcgggaggctgaggcaggagaatggcgggaaccaggaggcagagcctgcagtgagccaagatcgcgccactgcactccagtctgggcgacagcgagactccgtgtcaaaaaaaaaaaaaaaaattagttgggtgtggtagcacttgcctgtagtcccagctacacaggagaatcgattgaacccgggaggtggaggttgcagtgaagtgagatcgcgccactgcactccagcctggcaacagagcgagactccatctcaaaaaaaaaaaaaaaaagaaagtaaatcaaggccaggcgcagcgactgggaggccgagatgggcagatcacctgagttcgagaccagcctgaccaacatggagaaaccctatctctactaaaaatacaaaattagccaggcgtggtggtgcatgcctgtaatcccagctactcaggagccccaggtgggagaatcatttgaacccaggaggcagagattgcagtgagccaagatcacatcactgcactccagcctggatgacagagcaagactccatctcaaaaaaaaaaattaaatgaaaacagatgggtgcagtgcctcatgtctataaatcccagcaccttgggaggccaaggcaggaggattacttgagcccaggagtttttatttatttatttatttttgagatggagtttcactcttgttgcccaggctggagtgcaatggcgcaatctcagctcaccacaacctccacctcccaggttcgagctattctcccgcctcagccttctgagtagctgggattacaggcatgcaccaccgcacccgactgattatgtatttttagtagagacagggtttctccatgttggtcaagctggtctcgaactcctgagctcaggtgatctgccctcctgtaatcccaacactcccaaagtgttgggattacagacatgagccaccgtgcccggcaagcccaggagtttgaaactagcctgagcaacacggcgagaccctgtctccacacacacacacacacacacacacacacacaaacacacacataaaaaataagaataaaaataattagctgggcgtgatggtctgcacctgtagtctcagctatctgggaggctaaggcgggaggattgcttgagcccaggagattgaggctgcagtgagctataatcctgccactgcactcctggtcgacagagtgagatctcatctcaaaaaaaaaaaaaaaaaaaaaaaagacctgtgtggtggctcatgcctgtaattcaagcactttaggagggcaaggcagaaggattgcttgagtacaggagttcaagaccagcctgggcaacattgagagaccaagttctgttgtgggttgatttggcttttttttttcttttttaaaatgtggtttgtttcaagtttcccttctccacgataggctaatactgatcatgtcattccaccacttaaaacttctgttggggccgggtgtggtggctcacgcctgtaagcccagcattttgggaggccaaggcgggtggatcacaaagtcaggagattaagaccatcctggctaacacggtgaaaccccgtctctactaaaaatacaaaaaattagccgggtgtcgtggcgggcgcctgtagtcccagctactcgggaggctgaggaaggagaatggcgtgaacccgggaggtggagcttgcagcgagccgagatcacgccactgcactccagcctgggtgacagagcgagactccgtctcaaaaaacaaaaaaacaaaaaaaacatctgttgggggccaggtgccttggctcatgcctataatcccagcactttggaaggccgaggtgggtgaatcacttgaggtcaggagtttgagaccagcctggccaacattgtgagagaccctttctgtacgaaaaatacaaaaattagccagccatggtggcaggagcctgtaatcccagctactcgggaggctaaggcaggagtattgcttgagcctgggaggtggaggttgcagtgagccaagatcatgccactgcactccagcctgggtgacagagtaagaccctgtctcaaaaacaaacaaacaaacaaatcccacttctgttggctcctattaacgtgtcatttaaggaagccaattggccagtttaggcagcacatgacacagtctccactgatggccctgagtgtggccctgggttcacaggacgagaggtggctagcgtcttacaggtactaaccaaaatcacaataaatcttataatcagaagaccattattactcatttacaataagagagataactgaccagaatgtaagttttctgatgcgagcgcagagcattgtgcctggcacagagtaggcacttaagaagtttttgtaggatggatagtaagaaaaggaagggagagaagagggggtggggaaggagcaagtgaaaggggaaaaaagctcattctctttctgtaggaaggctatttgaggagccaagttaaaatcagattgaatagtgcttattcctccactagactaagtaccaccaagcaggaccatatcacattcactttgcatccccaagtctagctcctgggagatgcttaatacaggtgtgctgaacctatttgtcacttaaatgttcattatctcaggatcttacaaagggcttcttttcctgaaatccagcaaggaggagttttagtccgcatgtgtctgattacccaaagaaatgtttccttccgcttgaaggcaaagccacagtctttctttttttcttttttctttttttgagacggagtctcaggatctcagctcactgcaagctccccctcccaggttcctgccattctcctgtctcaacctcccaagtggctatgactacaggcgcctgccaccgcgcccagctaatcttttatatttttagtagacacgcggtttcaccgtgttagccaggatggtcttgatctcctgacctcatgatccgcccacctcggcctcccaaagtgctgggattacaggcgtgagccactgtgcctggcaatttttgtatttttagtagagaaggggtttcaccatattggtcaggctggtctcaaactcctgacctgaggtgatccacctgtctcggcctcccaaagtgctgggattacaggcatgagccaccatgcctagcaggaagccagagtcttgtatgagctcagtcaagcacaagtggtcccattcttgctggtccttgccttaggaatgggcatgtgccctgatgggatgggatgtaaagggagagctctcaggtttctggaggaagtgctctttgcccttaaaaagggacacaagggctggccttggtggctcatacttgtaatcccagcatattgggagggcaaggtgggaggatcatttgaggccaggagtttgagaccagcctgagcagcatagtgagagacctcatctctgcaaaaaagaaaaaaataaaagaggacacaaggccaggcatggtggcacataactgtggtcccagctacttgggaggttgaggcaggaggattactggagcccaggaggttgacgctgcggtgaatgatgatcgtgccactgcactccagtctgggcaacatagtgagaccctgtctctaaaaaaaggacacaaggaaatgactgtccttctcccactgggcattggcataactggatgtgaggcctgggataaccagccagaggatgaagccaaaacctgaaagaaattagaaccaaaaaaaatcacacagaagcagacccacggcctggacatcctgcatcttgagctgcctgctacagagttcatgttatgaaaaataataaatgcccttgcgcctggctcaaactattttgaatagggatttctgatattgcagccaaagcatgctaatacagcttgttagttaagatgattacatcatgaatccatggcgagtaaacttttgtaagaccattgagtcactctggtgttgcaagtatagacggatctgattgcctaattccaggagggttaggccctgacctcagtcatgactactttctgaataggcttggcaccaggaattgagtgggaggaacctaggtgatctaggagtttaaacaaaaataaaatcttcaattttagaagaaaagatgtcccaagaaactgctccatgatgggtaggagataaaaaagtggaaacaggtacctgagcaggaaaaactatgttcatgattttatactagctcttgaggttttagtcttgtgttaggaaaagtggatttaggattaaagtcttctgtccgtacacaatctacagcattaaaagattttaccctatcagattggcacatgcctgtgggaacagctaatcgggaggctggtgtgggagcatcacttgagcctggaagttggaggttgcagtgagccaagatcaagccactgcactccagcctgagtgacagagtgagacccctatctcaattaaaaaaaaaaaaaaatcttaccctatcaaagattcgagttcagtgaagatccattataaaatacttcctccttcaaatagagatgatgataacaggcatcgatgcaatactcttagtaagcattgactcttggttgttttttagtcaaagatttctaattctggctctattactgaaagaccatctggccacccattatggtacacaggttatataacaagaatgctatggttattgactgaaagccattttataatgagacaccctattgctattacataaaaggcagtctcagctatagaacgaattctcccttggtcagtcactgtggtcctactaatcatggagggaaaagatgtttctctcagaaaatctaaactgagtaggaaagccccaggaggtgcaagcctggttgcacattagaattggctagaagttttaataaatactcatgatagcccttgaacatatgaaaagatgcttgacctcactcctaataagagcaatgcaaaataaaactactttgaacattttttttcacctatcagattggcaagagtctaaaagttgaacataaaattttattaatatccagttctcctctacttctgagaatatggactatacaatttcctgcaccccctgaatttaggcttagcatgtgactcattctggcccataaaatgtgagcagaattaacatattttcctctgggctgaaggatttaatagctggtgctattaatcaaactatggggattctccagttctgttccccaattcagctactaagtgagaaggtgaagtgttccatttggtgcagcctcaggatgggggagtttcaccaccctggatctgagccgctgcaccgaggaacattgccctgtgtcagaaatagttaagccactgctgcataatcccagcccattgtgacacacgctgttgatgaagctgtgagtaaacaggtattctcctatattgctgcaatagtaccaaatgctaaaagcatcatggagggcaatttgaccatagctatagatgcacatttatcatttaatctatcatttaattccacttctgggaattcatcctacagaaatgcctgcatacatatgaaatgatgtatgcacaaagttatacattatggcattgtttgtaacgagagtttggaaataaatatctaagtatggagactggttaaatagactatggtctatcttcacaatggaatagtatgcaaatataaaaacaaacaaacaaacaacaaggaaactctcaaaatgctgatgtggaaattattccaggatatattgttagatttttaaaaagcaagacgcagaagagtggatatgtttcctttagtgtaagaaagggggaaaataaaaatattcttacataaacatttgtgtgatacacaagagatgaatagaagtagttaactatagggtcctccaagtcggatgggatgggagcaggacttctcaataaataccatttgtatcactttatatttgaaccattttaatacattatttttttttaatatagtactcaggtctccctgcaagccaaataaataaatcagtcttctgggatcaggactgggctttttgttgttgttgtttttttatgctatgcaggtgatcaaatgttcagtcagcactgagaatcggtgttttaagcttcagtctcagatgaaacacgatatctgagaggcagtttttgtgttgtgggtatgggtagtatttggcctttgctctgtgttctagaacctaactctgatggctcaagtaacccttctggttggaatactataactagatgagggagctccatctggcacagatgttgacagtgctgtgggatatgcccggatcatgtgccaggctatctggaactgaatactctgaactagagaattgggctagacacagagatgaagtaagatgcaaaccaatattgaatttatcaaggctgtgtggttataatcaggggtcttttttaggggaagacatctattagaagttgtggtagtaggttgggcacggtggctcacgcctgtaatcctagcactttgggaggccaaggcgggcagatcacgaggtcaggagtttgagaccagcttgaccaacatggtcaaaccctgtctctactaaaaatacaaatattagccaggcgtggtggcaggcgcctgtaatcccagctactcaggaggctgaggcaggagaatcgcttgagcatgggaggcggaggttgcagtgagccaagattgcgccactgcactccagcctcggcgacagggcaagactccgtctcaaaaaaacaaaaaagaatttgtggtagtgaccttaaaaaagttctgggtcacactgggagcaacacaaaaggcacacattcaatatagaagatttttgacctaaagttggcaaacaatggcccatgggccaaatcttgcccatcaactctacctttatggcttgtgggcaaagagtgtttttttgtttgtttgtttgttttgagatggagttttgctcttgttgcccaggctggagtgcaatggcacgatcttggctcaccgcaacctctgcctcccgggttcaagcaattttcctgcctcagcctcccaagtagctgggattacaggcatgtgccaccacgcctggctacttttgtatttttagtagagacagggtttctccatgttgatcaagctggtctcacctcaggtgatccacccacctcagcctcccaaagtgttgggcgtgagccaccgcacccagtcaagagtggtttttacatctttaaacggttggggggaaaatcaaaagaatatctcatgatacatgaagattatgtgaaattcaaatttcagggcccataaataaagttttcctggaatatagctgtacctaaacctattgggacaaagtcacatacagtgtggctgctttcccactacaatggcagagttgagtagttgtggcagacacgtacctggcactctcatccctttgtgctgctgctcagtgcactacaagttggagtgctgcaattataattcagcagtattttggccaggcgtggtggcacacgcctgtaatcccagcactttgggaggctgaggtgggcagatcacaaggtcaggagttcgagaccagcctgatcaacatggtgaaaccccatctctactaaaaatacaaaaattagccaggtgtggtggtgggtgcctgtagtcccagctactcaggaggccgaggtagaggaatcacttgaacctgggaggcggaggttgccgtgagccgagatcatgccactgcactccagcctggcgacagagcaagactccttctcaaaaaaaaaaaaaaaaaaaattgccaatgcacgttcttgtatcaaaagaagaaaagtataattttctttttttgagacagggtctcgctgtctcaatgcccaagctggagtgccgtggtgtttaatcacagctaactgcagccttgacctcctgggctcaagcaattctcctacctcagcctcctgagtagctggggccactatgcacagctaatttttaaaaattttttgtggaaatggggtcttgctatgttgcccaggctggtctcaaactcctgacctcaagtgatcctcctgccccagcctcccaaagtgctgcgattacaggcatgagccaccacaccaggccagaaaagtagactttggatgtcacactttcaaggcaaagtgtagattattttgttactgtatacaattgcaaggtcgggggcgcagtggctcacacctgtaatcccagctacttgggaggctgaggcagaagaatcacttgaacccgggagacggaggttgcagtaagccgagattgcaccactgcactccagcctgggtgacaagagtaaaactgtctcaaaaaaaaaaaaagcatacaattgcgaagtattgtgtttattatgcagtgacaccgtatctgtgctaaaagaataaaatgtatgttaacttagactaagcagtcatcacagtattaccaatttataggaaagcaacagtcagaaaaattggaaaattttggctaggtgctgtggctcatgcctgtaatcccaacactttgggaggctgaggcaggagaactgcttgagcccaggaatttgagaccatcctgggtaacacagcaagacctcatcactaccaaaaaaaaaaaaaaattggccaggagtggtggcatgtgcctgtgctcccagctgcttgggaagctgaggtgggaagactgcctcagcccaggaagtcgtggctgcagtgagctgtgatcatgccaccgcactccagcctgggtgacaaagcaaaacccgtctcagaaaaaggaaaaaaaaaaaaaaagaaagaaataaagaaaaaaaataggaaaatttcaaatggaacatcttatcagaatttctgcacaaaaatgaaaaatgaggctgggtgtggtagctcatgcttataatcccaacactttgggaggccaaggtgggaggatcacttgagcccaggagtttgagaccagactgggcaacatagcaagaccctgcctgtacaaaaaaaaattttttaattaggcaggtgtggtggcacatgcctatagtaccagctacttgggaggctgaggtgggagaatcacttgagccctggaggtagaggctgcagtgagctgtgatcatgccactgcactccaacttgggtgccagagtgaaaccctgtttcaaaaaaaaaaaagaaaagaaaaaatgaaaatgaaactgcaaaagtaagtttccaaggggcttatgtgttagccaaagaaagctgcttactggcggtgagttcattaaattgtgtttgtcgtagcagaagaaaagtgtccaaagaaaaatgattttgaatgattttccttgattatcaacgacttgatagatgttaccattagtgctcaattgttgtttatttgaggtgccaatgctgaatataaaatcactgacaaatacatttctcttgaatagtgtgcatggaataactataggcaatattctgaaaagttggccgggtatggtggctcatgcttgtaatcctaacactttgggaggccaaggacagcagactgcttgagcccaggaattcgagaccagcctgggcaacacagtgggccctcatctctaatagacttaacctctgccaggcacagtggctcatgcctgtaatccagcacttttggaggctgacgcaggcagatcacctgaggtcgggagttcgagaccagcctggccaacagggtgaaacgctgtctctactacaaatgcaaaaattagccagacgtgttggcacacacctgtcattccagctgctcgggaagctgaggcatgagagtcgcttgagcctgggaggcagaggttgcactgagccaagatcatgccactgcactccagcctgggtgacagagtgagactctgtctcaaaaataaataaataggccgggtgtggtggctcacacctgtaatcccagcactttgggaggccgaggcaggcggatcacctgaggtcaggagttcaagaccagcctgcccaacatggtgaaacccagtgtctacaaaaatacaaaaattagccatgcatgttggcgcgcgcctgtaatcccagctactcaggaggctgaggcaggaaaatcacttgaacccaggaggcagaggttgcagtgagccgagatcatgccattgcactctagcctgggcgacagagcgagactccatctcaaaaaaacaaacaaacaataacaaaataaataaataaaagacttgaactcagaccagacgtgatgaccagctgaatttaagcatattagtcagcagaggaaaagaaactaaccaggattccctcagtaatggcaagtgaacaggtaagagcccagcaccaaatgcctgccttgcagagtttttacatatatatgtgtgtgtgtgtgtgtgcattatatatatacgtattctttttaagttgagaaaacaataattcagtataacccaaagtggaatctgctaaaatgggtaacaagtgatggtggtaatcatgtatgaagcagaaaaaggcttagttgagcaaatttataaagccctggaaaatataaggtgtttagagcctatggttatttatgacattattcatctgaaactaatccatgataaaaatatatatatatttttgagacagagtctctctcagtcacccaggctggcgtgcagtggcgcaatctcagttcactgcaacctctgcctcccaggttcaagtgattctcctgcctcagccccctgagtagctgggactacaggcgcacgccaccatgcctcgctaatttttctatttttagtagagatggggtttcaccacgctggtctcaaactcctgacctcaggtgagctgcctgccttggcctcccaaagtgctgggattacaggtgtgagccaccacacccagccctttttttttttttttttgagacacagtctcactgtgtcacccaggctagaatacagtggcatgatctggggctcactgcagcttcaacctcctaggctcaagcactcctcctgactcagacttccaaagtgttgtgtttacaggcatgagccaccacacgtggcaactgtagctattattttttgatacggagtctcactctgtcaccaaggctggagtgcattggtgcgatctcggctcactgcaacctccacctcctgggctcaagcgattctcctgcctcagccttcccagtagctgggactacaggcatgtgccaccatgcctggtctttagtagagacggggtttcaccatgttggccaggctggtcttgaactcctgacctcagctgatctgcctatctcggcctcccaaagtgttgggattacaggcatgagccaccgcagctggtctggcgattgtaattattttagaagacaagagtttaagtataataccatctagaaaccctgggaatatgcaagctaaggaagaatcaaaatctatatgttacagcttttttttttttttttttgagacggagtctggctctatcgcccaggctggagtgcagtggtgcaatctcggctcactgcaagctccgcctcccgggttcacgccattctcctgcctcagcctcccgagtagcggggactacaggcgcctgccaccatgcccggctaattttttgtatttttagtagagatgggttttcaccatgttagccaggatagtcttgatctccttacatcgtgatccacccacctcggcctccaaaagtgctgggattacaggcatgagccactgcgcccggcctattacagcttttttaatggtttctttctgtttctctactcattgctgttttgctatctcagcatttagtaactttttttggaatgtttttgacagggtcttgctctgttgcctaggctgaggtgcagtggcacaatcaaggcttactgcagcctcgacctcctgggctcagatgatcccccaacctcagcctcctgagtagctgggacttgaacacctgggctcaagtgatctacccaccttggcctcccaaagtgctgggattacaggcatgagccaacatgcccagcctggaaagtttattttatgcttgtctcaactgtgctaaggaaaaataaaggaaagtatcttttacaaaaattttattatgacaaattccaaacatacataaaagtattatagaatataattaaccctaccctcgcatcatgtcacctggtttcaataattatcaatctcacatggccattcttgtttcacttttatctaacccacaccttattcccctctggagtatttagaagcaaaatgagagatatttggttctttttttttttttttttttgagatggtgtctcactctgtctcccaggctggagggtagtggcacaatcttggctcactgcaacctccgcctcccaggttcaagctattctcctgtctcagcctcctaagtagctgggactacaggtgagcgccaccatgctcagctaattttggtatttttagtagagacagggtttcactatgttggccagactggtcttgaactcctcacctcaagtgatctgcccacctcagccttgcaaagtgctgggattacaggtgtgaaccactgtgcccggactttacttttttctaaaaagagagtttatttaaggaaaatagagagcagagagtttatttttacaatgtttttacattgactgggtgccgtggctcactcctgtaatcccagcactttgggaggccaaggtgggcgggttgcgaggtcaggagttcaagaccagcctggccaatatgttgaaacctggtctctactaaaaaatacaaaaattagccaggtgttgtggcatgcgcctgtagtcccagctactcaggaggctgaggcaggaagaatcacttgaaccagggaggcggaggttgcagtgagccgagatcacgccactgcactctagcctgagcaacagagtgagactctgtctcgaaaaaaagaatgtttttactttttttaaaatagagatggggttttgcaatgttgtccaggctggtctctaactcctggcctcaaaggatccacctgcttcaccttcccaaaatgctgggattacaggtgtgagccactgcacctggccaagagcagatagtttatatagacagatagtacaccctgaaaagatgaggcaaagagggctgaggcaaagagggctgctgaaaagggagtgagccagcagctaatgttcaattatcatttttctctggcttcctcccatctttatccatctacattcaaaaaccatacattaagtatgtatcggctgggcgtggtggctcacacctgtaatccgagcactttgggaggccaaggcgggcagattatgaggtcaggagttcgagaccagcctggctaacatggtgaaaccctatctctactaaaaatacaaaaattagtcaggcatggtggcgcgtgcctgtaatcccaactactcaggaggctgaagcaggagaatcacttgaatccagaaggcagaggttgcagtgagccgagattgcaccactacactccagcctgggcagcagaatgagaccccatctcaaaaaaaaaaaaaagtatgtattatgtgctaggtactgggaatagaaaaaataatatatagcaggctgccctcaagatgctcagattgggatgagaaaaatatttatgaacaattacaatagaatgtgataaaaattaatttaggctgtgcccacagtgtatacatagtaatcagagagtatggtcagttttggttctgcttttagaatatgtgtttggagtcaccagagatgtgacccctaaatgcttcatgctgattattagcctactaaaggaaaaactatggagaggtgaaggacgctctgcatttagagggcagagagcgggttgctgtggctcacatctgtaatcctagctactttggaggctgaggcaggaggactacttgagcctaggaatttgagacgagagtcagcaacagagagacatgtctttaaaaacaaaacaaaacccaaaaagcctaattcagtcaaagcatgggtagaagccagattaagaaggttgagcagctgggtgggtggctcacgtctgtaatcccaacactttgggaggccaagctgggaggattacctgagcccagcagttccagatcagcttgggcaatacagtgagacctcatctctacaaaaaatttaaaaattaaaaaatcaccactaggattacaggcggtggctcacgcctgtaatcccagcactttgggaggctgaggcaggaggatcatgaggtcaggagttcaagaccagcctggcgaacatggtgaaaccctgtctctactaaaaatacaaaaattagctgggcatggtggtgcatgcctgtaatcaatcccacctacttggcaggctgaggcaggagaattgcttgaacctggacctgggaggcagaggttgcagtgagctgagatcacgccactgcactcctccagcctgggctacagagctagagtccgtatcagaataaaaaaaaaaaaaaagggctgggcaaggagcaggtgattatgaagtggtaaatctgacagtgaaaagtagttagaaaacaaagtggagatttttctctccaccctcacccacccactgagggtgtatgctcagggttttagggtatagaggtagaggcccagggaatgactgaataataataatggaagactcatatgatgcttactatgtgccaggtactattctaagcactttgcatatattaacttgtttcatacatagctgggcggggtggctcacatcttggctgagggggaggattgtttgagctcaaaagtctgagacgagcctgggcaacatggtgagatttcgtctctattaaaaatcaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatcaaaaaaattagctgggcatggcagcgcgagcctgtagtcccaactactcggaaggctgaggtgggaggatcccttgagatggggaaatcaaggctgcagtgagccatgatagttccactgcactccagcctgggtgacagaaggagaacctgtctcaaaaacaaacaaaataaaacaaacaggctgggcacggtggctcacgcctgtaatcctagcactttgggaagctgaggcaggcagatcacctgaggtcaggagtttgagaccagcctggccaacatggtgaaaccccgtttctactaaaaatacaaaaattagcagggcatggcggcggacagctgtaatcccagctactcgggaggctgaggcaggagaatcgcttgaacccgggaggcggaggttgcagtgagccgagatcgcgcccctgcactccaacctggtgacagagcgagactccgtcgaaagaaggaaaggaaagggaaagggaaaggaaagggaaagggaaaggaaaggaagagagagagagagagaaagaaaagaaaagaaaaaagaaaagaaagaaagaaagaaagaaagaaagaaagaaagaaagaaagaaagaaaacaaacaaaaacaaatagggattaataaataggcagaagcaggcataatccggggcaggggaagcctcggggccacgcccgagaggcatttgtattttactttcagcagttcagagcccatgatagccaggttacccacttgtggacttccttgaccacttaattgagtcaatctaaccctcaccttctctctcctctcactccatttagcgggtcacgtagccactagggcttccttagcctatcaggccacctggggactgagtcattcagtcagtcacctatctggtggtcacatctgcccctgggctcatccttttactgggccacctcggcccatcgggacctgtcagtccttgacctccctcaggcccctaggctggccaggtcgcctcagtgccacgcctccctggcccgcgattcagcctgcacgttacgctttgttcccagaagcaggttttcgaaacgcggttccctctcggctccagctgttttcctgccagcgctgggagacccggcagccgcagcgcccccagcggcgcgcagcggcccaggaagagagtgcctaccgccggcgcctcttcagcctcctcctggaacgcgggagcgggcgcgaccagcgcccaccctgatcgtcgcgacggtgctcctgattggctgcgctgtgtgacgtaacgggagggccccggcggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtacgcgagagccctccccgaccgcggaggaaggtcgagaaccgggtctgtcgaagagtgcttgtataggggggtggggcgcgcttgaacccatattccccgcattctgaaccaaattattttccagaaggccttcctaacagaaagctagtgtcaggatctgggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctgtctttgccctctttcgtccttcctttactgcagctgtactaggctgctcacttattccctggtagccatccttccttactcatacctttgtacctttgcacctttgctccagctgttggctcttcactgactgccttaactacacctcactctccatctgttgaaatcctacctgttgttccagtcccctcacagattatagggcctttctctgaccctacccctcacgttcagctttgtttctccttctctgtgccctctgcctcaggcctgttgctttaatttagtttttcattttcctaggtatctctgaaggagatcaccatgctggttgaattagatcctgactgagtttactttgttatactgaatcttcgaattgccactcccaagcctggttttcatggcttaggtttaacatgttattagccttttatagaaagctagtgactactagagcctgggccaaacggaaaactcagtgtaatgcttcttcgcatcccaaacagggtacatttagtggcttaactttgcaggcatcaaaactgagcttttaaagccagagtttcatgcctcttggctaatattttggtttatcttgcatagctaaaatttgtaacaataatgtcctactcgaaatttaaggactggtggcttgcattgttatagtcttatccttttcattagaatgcttcataatttttaattttatatttttattcaaatgtttataagagaattataacccagtgtaacccagtgtaggtactgggaaagatgtgtgacagacatactttcttcctgtggaactcctactgtagtggagaagacagactgaaaagtagaaaaataaagtactagtaagatcaatatacaggagggacctacctggggtggcgtggtcagagaaagcatgaagctaagacctgagggtaaagaagaacccagcctaggcaaggcttggcctgagaggaggagaagagccttccaagtttagggaaaagcttatgtagatgtcctgaggtgagaaagtccattgtgttgggagtgtgtttcttttctttctttcttttttctttttttttttcttgagacggagtcttgctctgtcgcccaggctggagtgtgcgatctcggctcactgcaagctccgcctcctgggttcacaccattctcctgcctcagcctcccgagtagctgggactacaggcgcctgcaaccatgccgggcaaattttttgtatttttagtggagacggggtttcaccatgttagccaggatagtctcgatctcctaacctagtgatccgcccgcctcggcctcccaaagtgctggaattacaagtgtgagccactgcgcccggctttttttttttttttttttttttggtagatgacgtctcactctgtggccaggctagagtgcagtggcccaatctcggctcactgcaacctctgcctcccaggttcaagtgattctcctacctcagcctcctgagtagctgggactgcatgggactacaggcacccgccaccatgtccggctaatttttgtatttttagtagagacaaggtttcaccatgttggccaggatggtccctatatcttgacctcatgatccacctgcctcagcctcccaaagtgctgggattacagatgtgagccaccctctccggcctgggagtgtgtttcttaaaggagaaagggggacatataaaatgagtttggagataaagatcagggtcaggaattgggtttttatttaaagtgctgtgggctccaaggaaggaatttgaggcagaggagtgacctggggctgttattgtaatccagctacaaaatgatggtgactaatagtgacagtggagctgtgacttggagatgcctattttggagataaaattgatttgctggtgggtggggatgaagggaaagggaagaagggatgatttggtctatttgtaactttgttatcttctgtgtttttatctttaactgctttttgtatttgtggtattcctatggtggattttattttatttatttttttgagaccaagtctccctctgtcccccaggctgtagtgaagtggcataatctgggctcactgccacctccgcctctggggtttaagattctcctgcctcagcctccctagtagctgggattacaggcatgcactgccacacctggctaatttttgtatttttggtagagacagggtttcaccatgttggccaggctggtcttgaactcttgacctcaagtgatccacctgcctgggcctcccaaagtgctgggattacaggtgtgagccactgcgcctggcctagctctagtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtagctggggtaaatgtttttatgattgttatcttctaaaactattattaggatagtggtgcctgtctgatcttgttaaaaacaactcttgggacttttgcaattaggttactaggaaaagtattaaaattaaaatgagaaacagacaagtaggacaaaatgtgctgataattgaagcttcgttattcccctagatagtattacagagaatgatgatggcttaggtgactttattccttaaattattttacaattttttttaatcttgattttcaaaagaggattcctgtaagtaaagagatattttaaaaccagtttgtgtttagctattttcttttcttgctgacttttctgcaaggaaagagttgatcctgagatttgatttgaaggggaatacttggtatctgtaaggtgagtagagcttgtgtgatgagactaacgtcactgaatagctgtagacaggtgagcatgctgggcaaagggcaaaagtggcaaaagacagccagggcagtgggctgttgccatatcacgaagggctgagctgaggagattaacaattttcttgcattgccttcatttgagtcatgaaacagccagtttctcacaactgacaaggtcaggtttacaggcaatttctttttatatattaatttttaaatttagagcaaatgcttgactgtcatgtaataatatcattctcattcatttgcattccagtatgcttttctgactaaaacggaagaaatagcaactttagaattgtacttaaccctgggtacacacacccatgactatttgtatgaaaatttgtatttaagtgtctaaatgcagcctcacctgtgcttttcccccatggtgtggcataagaaaacaattggtgacacaagctggggatctgtgggaattgaagtcagtgaaacagatcgtgtggaggaaaaatagtttcccaggcttacaagtgagacttaaagtgatttgggatggaattggtataaatcaagcagaaaggttgtattgataccttaggtcatttagttcaatcattttccctgtgcttttagccctcttcagagtctaactccatggccctccagtctcaacttggacacctccaaaaaaacattcacttcaacaaaagtttattgagtgcctattatgtgacaggctaggaacttgggatacagtagtgaacaaaacaaagatgtatttcctgtggcacatctggaacataagttgctttttttttttttttttttttttttgagacagagtcttgctctgtctcccaggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtccccttcttgtgtttgcctagcccagtgtgtggacttaaaagtgcatggccccatagttgtccctcttgagttttgtagttttgttgttggtttggtttttattggtcttgtcatatgatctgcgtacatctctgaatccttttttttttttttttgagttgaagtctcgctcttgtcgcccaggctggagtgcaatggcgtgatctcggctcactgcaccctctacctcccaggttcaagtgattctcctgcctcagcctcctgagtagctgggattacaggcacctgccaaccgcgcctggctaatttttttatttttagtagagaaagggtttcaccatgttggccaggctggtctcaaactcctaacctcaggcaatccgcccgcctcagcctcccaaagtgctgggattataggcatgagccaccacgcccagcctctgaatcttttaaaatcctggttatgtcatctagcatattcattaccctccagtttcctaactgcaggttttgtaaaagcaccaacagatctttgtactaaagtccttctatgcagcctctccagatctgcctcttatatctataaaaagacagtgaggttgatctggcgtgacttgttcttggtgggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgcccgaggaatcatttccacttgcctccttggacctttcatcaggactgaccaggatcctcctccacccttctgtctttgacattgtgtcagttgtccttcacagcatctcagctttatttctttagtaccaaaagtgctttttttccttgactataataccatgcaaatgtaggaatctttagaaagtcctttagaatattctcgtatttaaaaatatatacatatgtgtgtttgtgtatgtgtatatatatatatattttatgtgtgtgtgtgtgtgtgtgtgtgtgtgtgtgtgtgtgtgtatatatatattttttttttttttttttttttttgagatagagtcttgctctgtcacccaggctggagtgcagtggcatgatatcagctcactgcaacctctgcctcccgggttcaagcagttctctgcctcagcctcccgagtagctgggattacaggtgcccgccaccaggccgggctagtttttgtatttctagtagagatggggtttcaccaccttggctaggctgctcttgaactcctgacaacgtgagccactgcacccggcccagaaaaaaatatttttaaaaggtttttgttcctctttcctaatgtgtaaattaagtcagaatgccatggaattggggccctggtgtggttcaggcagggcctgtcccatcctggtcattaggctgacctctgttttctgtgatagctgttctctggtgatagctgttgagtaagaagaaccatcagctaggggttcacagagagaagtttattctcatgactgctcccacactaagagcttgaggtttatatagtttgccaactatctaccttctgtctatgaatttacctattctacctacctgatataagtaaaatgatacaatatttgtcctttgggtctgaattatttcattgggtacaatgttttcagagttcatccagattgtagcatatatcaaaacttcatttcttgtcccagcatggggtgactcacacctgtaatcccagtgctttgaaaggccaaggtgggaagatcacttgaggcaaggagtttgagaccagcctgggcaacatagtgagactccatctgtacaggaaattatgataaagacttcattcctttagggctgaataatattccattgttatgtatatatcacgttttgttaatccatttatctcttgatggatacttgagttgttttcgttattttggctatggtgaataatgctgcagtggacattgacacacaaatgtttgagtccttgctttcagttattttggttatatatctcagagtggatttctgggtcaaatgggtaattctgtgtttagctttttttttttgaaacggagttttgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatagacttggcaccctagtcaaaaatcagttggccaagctgggtgtggtggtgcacacctgtaatcccaggtaccctggagactgaggtgagaagattgcttgagcctaggagttgaagatcagcctgggctacatagtgagactcccacgtgttaaaaaaaaatcacttgatcataaatgtgtgggtttatttttgacctctgagttctattccattgttctatatgtctctccatatgccagcaccacactgttgattactatagctttttgtagtaattttgaagtcaaggaagtgtaagtcctctaactttgatgcttttcaaggttgttttggctattcaggttcctcgcaattctatatgaatttgaggattggttttcccattgctgcaaaaaaaaaggctgttagaattttgatagggattgtgttgtatttgtagatcactttgggtagtattagctttttttttttttttttttttaatttcttttatgaggcagggtctcactatgttgcccagactggtctcaaactcctgggctcaagtgatcctcctgtctcagcctcccaaagtgctggcattacaggtgtgagccactgcacctagccaatattaatatcttaatcataagtctttccatccattaacacaaatgtttttgcatttatttaggtctttaataatttttggtatgcaagtgtttcaccatggttaaattattctcgttttgttttgttttgtttagacagagtcttggctttgtcaccaggctggagtgcagtggtgcaatctcggctcactgcaacctccacctccctggttcaagcgattctcctgcctcagcctcccaagtagctgggactacagacatgcgccaccatgcccagctaatttttgtatttttagtagagatggggtttcactatgttggccaggatggtctcgatctcttgacctcgtgatccacctgcctcggcctcccaaagtgctgggattacaggcatgagccaccgcacagcctattcttggatatttttattttagatgctattgtaaatggaatcacttttttttttttcttcttggagacagagcctcactcccgctccattgcccaggctagagtgcagtggcacaattcttgtgcctcagcctcctgagtagctgggactacaggtgcctgccaccacgcccagctaacttttttttgtattttagtagaattggggttttaccatgttgcccagcatgatcttggcgcctcccaaagtgctaggattcaggcatgagctaccgtgccctgcctggaattactttctttctttttttttgggatggagtttcgctctatcacccgggctggagtgcagtggtgtgatcttggctcactgcaagcgccacctcccgggtgcacgccattctcctgactcagcctcccaagtagctgggactacaggcgcctcctaccacgcccggctaattttttgtatttttagtagagacggggtttcacggtattagccaggatggtctcgatctcctgacctcctgatctgcctgcctcggcctcccaaagtgctgggattacaggcatgagccaccgcacccggcttggaattactttcttaattattcattaccaatatataagacgcaactgatatctatgtgttgatctcgtaccctgcgactttgctgaatttgtatcttttcttatatatatgatcgtgtcttgacttcctcttttccaaaagcccacatactcttgtaccacagcatactggcctgtgatacctttagccccgccccctacctttcccaaataaaatctctgtgttaaccagtaaacagccctcttgaatcaagttactactctgaaggatagtggtaattttaagaaagagaccaagtcttcagtattaaaaccctattagatagcattcagttgtgggtttgagtgtatgagattacttgactgctagccagggcacacagacagggagcctagccctcttaaagcctctatctctctggctactctgattcaggtgcaggtgcacagagaacacaggggcaggcagtggacccatgcagctccgtgagggccaggggtgtttgtctcctttgtgtcctctgttgtatctcttcacggcctacacatagatgttcaatatttgttgaatgactagaggaataaaagccacagagagcaggatgatacctgtctggtgattatagtacatgggctttgttttgttttagatattttgggggctataagcccctttgagaatccagtgaaagttgtgcagtcttcagaaaaacagcatacattcatgtatttgcatacaacttcgcaggatgttctttgatcactgagacccattcacatcactcaagttagaatttatgattccagtgtcaccagtgtactcctgatcttacttttatgtaacctgaaagcatacaatctcagcctatcagtacagggagcggagactgattatggaaccaaaaaactgctgtgacgaccagtgcttgggccctccagtgcgttgactgctctttgaatcaagtgccagatgccagtcagtagagtcatttcctggacaacactctggacaagtagggctgtaggaaactattgccagcagcaagaggtaccctcttgccatttaactcttggtagacataaaagggctgactagtgtccctggcatatgtgttttagagttaatgtgtccactccccaggtgctaagtgcggccagccacaaagatagtgttttgacagttctaataatgattaggattggcctgttccatagagtgaaaattaataaggatgatgcattaggtatgtgcttcctcttaatctgttgataaggtcagccacatctcccaggtgtagtttgccccgtgaactgagttggtatctacccacatcaagattggtctgccctctaagactatactttcagggatcatttctatagttcattactagagaagtttctctgaaggtgtagagcacccctccctccaaaaaaaaaaaacagattgatctgccctccacagtgagtgcttctttgagctggatccgtgtaccatgaacccagaggaagagcaccacaccagaatagggagtgatgagggaaacggcaagatggctgccaagctaccagccattttaggatctgagcacaagcactgtttggtagagccatggaagaagctggtccatagccaggcctgtaactggacagcaggctgcataacagccaggatatctttactgtgttgagatagaaaacagcatgaagaatgatgatggtgttttagcatgtggaaactcctgcaaggccacaatgaggcactaatggtcaaggggccaccagaagtctctcagccattctcttcctaggctgctctttgacctacttctgctggtccaggttccctctgtctaagcagtagctccttgaatcctgtgctctgcagcattgagttaatagtgtttttctgccacttgctgcttttatgtgttttctgtctctctctcttttttttttttttcaatagaagctaggtctcactatgtcacccaggctggtcttgaacatgtggcctcaagtgatcctcccaccttggcttcccaaagtgctgggattacaggtgtgagccactgcgcccagctacaccaagtgcagtgacacgattttggctcactgcaacctccacctcccaggttcaagtgattctcctgcgtcagcctcccgagtagttggaatttgggattacaggcatctgccaccacgcctggtgatttttgtatttttcagtagagatgaggttttgccgtgttggccatgctggtctcgaactcctgacctcaggtgatccatctgccttggcctcccaaagtgttgggattacagatgtgagccactgcgcctaggctttttcttttcttttcttttcttttttctttttttcatttttttttttttttttttttgagacagggtcttgctctgtcacccaggctggagtgcagtagtgtgatcacagcttactgcacccctgcaacctctgcctcctgcgcttaaacgatcttcgcacctcattctcccaagtagctgggactgcaggtgcatgccaccacgcctggctcatttttgtattttagagacagggtttcactgtgttgcccaggctggtcttgaactcctgggctcaagtgatccacccacttcagcttcccaaagtgctgggattacaggtgtgagccactgcgcccggccactttgtgcttttcacactatgttattatctgacaaagattcattgtgtatcccactcaaaagacagaagttttttaaggatacgaactgacctgcccattttccatggagtagatgttcagtaaatttatttaattgattaggtaggatcatgtagaaagtatcctgttgaagaccgccagactcacaagttaattggaaggcgtgaggtgtgagtgttcttggcagctttcaatccttagcctcatctttaatcttcccgtagtcttctttggctgcttagtatccatcacagtcatttattagaccccgttttcagcctgttcctcattggttttgagaggacccttgttggtgacaaggttggaaatcctctgatatatacagtgttgtgcttctcagtgctaattccagctcttcccttcgtgcatccaaagggtatgatcattagagggggcgtggggttgggggatgggttctattcaggaatctctactcaagtaacaatcatttaattactgcaagaacctttcaaagttggaaggaaactgagacttggagaacttaagcagtttgctacagtcatgtagtttctaaaagtggcagaaccaggacatttgtttggtgtcctgcatgctccaaagttcatggcacggaccattggactgtgccataaaaaccttatgcctgtttttattttgagatgtagtcttgctgcgttgcgccggctggtctcaaactcctgggctcaagcagtcctcccacctcagtctgccaaggacctggaactagaggcatgtaccacgatgcctggttctatatgtgtttaagcagacaaaagcttatttcttattgtcttagatcttaggtgggtcttatattcaagtagcgtttttatggacctaagtacacaatacagaaccttagattagtgctctgctgaacagagtaacaccctgtctacaatgactaccacctgaaggtctttttttaaaatacacctttttgtgtaatttgactttaaccattctcagaatcatgtgttcatttctatcctgttggggttagtggccaaaatagaaggttggtgtggggtggggagctgctttgtgctcaaaagctgtttctgtgtgtgtgtgtgttttgatttttgtttttttgagacagggtctcactcggttgcccagtctggggtgccgtggcactatcacggctcactgcagcctcagcctcatgggctcaagccatcctctcacttcagcctcctgagtagttgggactgcagtcatgtaccaccacacccggctaatttttctattttttagaagagatgaggtttcaccatgttgcccaggctggtctcgaactcctgacctcaagtaatcccaggagttcaaggttacaatgagctgtaatcgggccactgcattccagcctgggcgacagaccccgtctataaaaaattaaaaaataatgtgcatggtggtgcacgcctgtagtcacagctattcaagaggtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagctaaccagggttgaatggtatcaagcagaagtcatgggaagtgagcagcctcattgcaggtcagggcatgatatctgtgcggctttcttgaatccttttctgttcttggctgtaggtggttctcctgatgaactttgggagacctccaagtggattggcttgaggtgttgggaggcccactgacaccccctcagccagggccttgtctctcctactcccagctctcagtacattttatctttcacttcactgtactctattcccatgcctatttgtgtattttgaggtgcatattttcttgtaaaacctcaggaagccatttttaaaaattatggctggatgtggtggctcatgcctgtaatctcagcactttgggaggccgagatgggcagatctggagttcaggaccagcctggccaacacggtgaaatctcatctcggcaaaaaatataaaaatgagccaggcatggtgatgcaggcctgtagtcccaactactgtgcagggagggccaaggtgggaagatcttttgagcttgggaggcagaggttgcagtgagctgacataccactgcactccagcctgggtgacagaggaagatccttctcaccgccctccccgcccccacccccactaagacagtcttgctctgttgcccagagctggaatgcagtggtgtgacgtcacctcattgcaacctccacctcccgggttcaagcaattcttctgcctcagcctcccctgagtagctgggattacaggtgtgtgccaccacgtccagctaacttttgtattttttagtagagacggggtttcaccatgttggccaggctggtctcaaactcctgacctcaggtgagccacccacctcagccttccaaagtgttgagattacaggcatgagccactgcgcccagctgagaccctgtcttaaaaataaatttaccagcactttgggaggctgaggcactttggatcacaaggtcaggagttcaagaccagcctggccaagatggtgaaaccccgtctctactaaaaataaaaaaattagctgggcatggtggcgggcgcctgtaatcccagctactcgggaggctgaggcaggagaattgcttgaacccgggaggcagaggttgcagtgagccaagatcacaccactgcactccagccccatgggtgacagagtgagactccatctcaaaaaaaaaaaagttaaaaatttatttaagacagtgtcttgctcaggctggagtgcagtggtaagatgatagctcactgcagcctccaactcctgggcccaggcaatcctcccaccttggcctcctcagaagctgggattacaggcatgaccctctgtgcctggcccaggatatatatatatatatatatatagaactatgaggctaaaatgtccctggttcctactttcaggtttctgctgaatttgagagaagtctgtcttgaaatatcaaaactgtcacatcattctggaagaaacaatactccagagacatctttgaaaactacctttagagcctggtgcggtggtgcgttcttatagtcccagctactctggaggctgaggctggaggattgcttgagcctaggagttccagactgcagtgagttatgactgtgcctgcgaatagccactgcactccagcacggtcgacatagtgacacctattgagacatagtaggatctcaattttttttttttttttttttgagacagtgtcttctgcagtggtgtattctcggctcactgcaacctccacctcccaggtttaagcgattctcctgcctcagcctccccagtagctgggactacaggcttgcgccaccatgcctagctactttttgtgtttttagtagagagcaggtttcaccatgttgaccaggctgctcttgaactcctgacctcaggggatccgcccaccttggcctcccaaagtgctgggattacaggcatgagccaccacctggccagcatctcaatttttaataaataactaaaaaataacttgtttgaacaggtatatcttggccagcaatgctggactgggttcctttgaggtgagggaaactcttggacatgggacctagtgggggcctctgcttgcctccctgctgggttaacagtacagctggcccagccagtcttgaaaccttaccctgcaacaaaaacttgacacctccaggctggtaattctggaggtgtcttctctgccaagtcggtgactccccaacccgctattatggctggactctgctcttgcagtcttagtgtacaccctggttcttcaagggcagcaagcaggactattccggtagcaaccagagctggagctcagggccccgcactggaaagctggggcagcttaggtggtaactagtgtgctgaggatgaggggcgctatggagcccaggcgggtttaggaagcattcttggcttcctggaggaggggaaatactggtaattcaggctgaaggagctggatggggccaggggcagtgactcacgcctgtaatcccagaactttggaaggcctgagacgggagggtcgcttgagcccagaagttcgagaccagcctgggaaacatggcaagacctcgtctcaaaaaagccacgcgtggtatgcgcctgtgctcccagctgcttgggaggctgaggctggaggatcgcttgagccctggaggtcgagactgctgtgagccgtgattgcaccactggactccagccttggtggcagtgagaccctgtccccaaagaactgggtgatctcgaccctccacatcgctggctctccacgggcgctgcacagtggagacccaggatctgattgcataggactgggcactggagtttaagttctccaggggggtttaatatgcaacgaagttgggaaccactaccagtgaaccccttcattctgtgcggctccagctcccggaagccctcggacaaggaactgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggtagggcatctccagcgccgactccggggaaggtggacatcgcacggaagggggtgaagggcagggaggatcccagcttgggatgggggtagagggtggcggaccttgcgcggggcgggtgtggagggcggcccaactctcgtggcccctggtgcttccgggagctccgtcctcgctctcggatcccaaggaagaacttgacctttccctgacatcctccagtgcccatggcttctggcgtccacggatggcggggaggggaggggggcgcattcagcgactgcagagactgggggctgtgggccggggcagctgcggggcggagggtggcgtgtggtggggttgggtggcgtggggttgcagaaggcggggcatggggcccaacggccggctgcgccgcccttctccgtatggctcttcggagccgttgcatttgccctctcagggcttcctgggctctcggccctaagtaacctgtgtcccagagtccctgagggaggcgcaggatcactgagctctgccctccctaagatggaagcaggaccgtgtggaggagggacggccgcatgggatggccagggtgggggccccaagaggacagcctccgcccgctcgcccgcccgccaaggaaagccctgggggaacacactttcaggctaaggggtctgaggaagagaagactaacaagggggaagccctcgagatgcccaacagtcaagtccgggaaggacggagtagataaccagtaactgcctagagggtgggagccaagaagaggaggggcctggacagggctgcaaggaggaagacacaggcccccatgccagccttctggaaacagcggtttgcagaccacctgagctcaccaagacagctctgaagaatttagggaattatgctttggcttctgggttgaaggaaaaaaatagctataggatgcagcattcaaaagacccgtaggcagggcgcggtggctcacacctctaaccccagcaatttgggaagctgaggcggagaggatcatgtgagccccagggttcaagaccagcctgggcaatatagtgagtctacaaaaaaataaaaatgaaaaaattagctgggcttggtggcatacctatagtcccagctactccacaggctgaggtgggaggatggtttgaacctgggagttggcccaggtgtggtggctcatgcctgtaaccccatcactttgggagactgaggcaggtgaattacttgaggttaggagtttgagaccagcctggctaatcatggtgaaaccccatctctactaaaaatacaaaaattagctgggtgtggtggcccacgcctgtaatcccagctactcaggaggctgaggccggagaattgctttaacctgggaggcggaggttgcagtgagctgagatcgcaccattgcactccagcctgggcaacaaagcaagactcagtctcaaaaaagaaagaaagaaagaaagaaagaaaggccaggtgcggtggctcatgcctgtattcccagcactttgggaggccgaggtgagcgaattgcttgagtccaggagttcaagaccagcctgggcagcatggcgaaaacctgcctctacgaaaaaatttttaaaattagccagccatggtggcacgcccactcctgtagtcccagctactcaggagaatgaggtgggagggtcacctgagcccgggaagtgaaggttgcagtgagccgtaatcgcaccactgcactccagcctgggcaacagagcgagaccctgtctcaaaagaaaaaaaaaagaaaatatttaaaatatttaggcccagcatggtggctcatgcttgtaatcccagcactttgggaggccgaggcaggcagattgcttgagctcaggagttcgagatcagcctgggcaacatggtgaaaccctgtctctaccaagaaaatacaaaaattagctaggcatggtgacaaatgcctgtagtcccagctactccggaggctgaggtgggaggatcccctgagcctgggaggtggaggctgcagtgagctgtcatcacgccactgcactccagtctgtgccacagagcaggaccctgtatcaaaaaaaaaatatgtatttttaacacaattacaaaacactgtttataattaaaaataataaaatgtttgtaataaaaaaactttttcacggcagaataatattccactgtgtggactgagacagctggttttgtttgtttgtttgtttgtttttgtttttgtttcattttgttttttgttttttttttagacagagtcccgctccttcgcccaggctggaatgcagtggcgcgatctcagctcactgcaacctccacctcctgggttcaagcaattctcctgcctcagcctcccaagtaggtgggattacaggtgcccgccaccatgcccagctaatttttttttttttgtatttttagtagagacggggtctcgccatgttggccaacctggtctcgaactcctaacctcagatgatccacctgcctcggcctactaaagtgctgggattacaggcatgagccatcacgcctggcctgagacagctcatactagctcatcggtcactgggagtgtggagcttgttgtcaatcgtgtgtgtgtgtgtgtgcacgcacgcgcgtgtgcgtgtgtttagagagggggttttgtcatgttgcccaggctggtcttgaactccagggctccagcaatcctcctgccttggcctcccaaagaactgggattacaggtgtgagccacgctcctggcctgttgccaaattgatgatagaaattcctcatggggtctaattaagtgccacagggacagggctaccctgcagccctgtgggctagctcttgcccagccctcactgtaggagtcctctgacctcttccgcctacctcttgcctccttccagtccaacaccagtcttagatttctttcctgaagacacatgcaaccgggcacagtggcatatgcctgtagtcccatctacatgggagaatgaggcaggagaatcccttgagcctaggagttcaaggctgcagtgagctatgatcgtactcctgaactccagcctgggtgacagagagaaaccccatttcaaaaacaaaacacatgtgatgaagactccttacccagctccccctgttcctccagaccagccaacctccatgccaggcccctgcccagaacttcatggcaagctggactggactggcatattctgagttctccagaatttaccatcttacctccttgcccacactgtttcttctgtgtgaatgcccttttcctctcctatgaacacctacgggcatctgccctcagctcctgccacctccctccatgagaacagggattaagactggctatccctcaccaggcgcggtggctcatgcctgtaatcccggcactttgggaggccaaggcaggcagatcacctggggtcaggagttcaagaccagcctgaccaacatggagaaaccctatctctactaaaaatacaaaattagccgggcatggtggcacacgcctgtaatcccagctactcgggaggctgaggcaggaaaattgcttgaacctgggaggcggaggttacggtgaccccaaatcatgccattgcactccagcctgggcaaaaagagtgaaactccatctcaaaaaaaaaaaaaaaaaaaaaaagtccgggcgcggtggctcacacctgtaatcccagcactttgggaggccaaggtgggcggatcacaaagtcaggagatcgagaccatcctgactcacacggggaaaccctgtctttatgaaaaataccaaaaaatcttagcccggcatggtggcaggcgcctgtagtcccagctactggggaggctgaggcaggagaatggcgtgaacccaggaggcggagcttgcagtgagccaagatcgcgccactgcactccagcctgggagacagagcaagagtccgtctcaaaataaataaataaataaataaataaataaataaataaataaataagactggctatcccagagcctggggacaggagagtgtgcgctgcaaagccagccatttgaggagggcctagtctgaactgaataggtcaatgggctggagctgactttggacagagttgaacaaccccaaagaatccagtgggtgctgggcatacagtcgtcaggcctgtgtagacagacctgggccgagaagaagctgggctgcagtagccagggcaaggcagaggggcaggaacaggcatgggcgatggggttgggccccagttctttgacctggggaatcccccaacctatgcttccatatgaatgaatcactgtgcatctgtgggcaccactgcatcagcttgcccctccacacagctgcccttggctcatgttggctgtgctgtatcagtccttcaacgtttcctggggatcagttaattaagttgaggtctctgcgtctggaaatccgcctcagcctgcagggaaaaggcccctagtcttgtttctgccttcagaaccctgagacagaacaaggagaatcctgctgattctcagattgggctccagaggggcgacagtgtcaatcacaatgttagatactgaagttggctcagttctttttttttttttccttccccttctcccctcccgtcccctcctttcctctcccttcccttcccctcccctccccttcctcccttttctttctctttctcttttttttttggcggagtctcactctgccatctcactctgcagtggcgcaacctcggctcactgcaacctctgcctcctgggttcaagcgattctcctgcgtcagcctcctgagtagctgggattacaggtgtgtgccaccacacccagctaatttttgtatttttagtagagatggggtttcatcttgttggccaggctggtcttgaacccctgacctcaagtaatcctcctaccttggtctcccaaaatactgggattacaggtgtgagccactgcacccggccttttttttttttttcttcttttgagacagggtctcactttgtcgcccaggctggatgtagtggcagaatcatggctcactgcagccttgactgcccaggcccaagccatcctcccacctcagcctcccaagtggctgggactacaggcttgcaccaccacaccaaggtgaagtgttgttttgtttgttttttgtagagacagttttgccatgttgcccaggcagtgatcctcctgcttcagcccccacaaagtgttgggatcacaggcgtgagccgctacgcccggccactttcttacctaaaatacctgcacaccctacttggagaccctagggtgaggggagtggggaacaggagaacctgacagtagagggtacatgtaaggaggagagggacaagcttgctgtgtggtggggtgctccagggctgggggtgcctagggatccacctctctcccaggctgtggaattatcctccccgcactcactgcttctctaaccttggctatctcctgctgcctttggggtgtctgatgggcttgagggacctcccagctgctctaggtcatctcaccgcagccatgtgccccatttggtactgtcaaagctgctggaatattatcgtctttccagaactatccctggggcaatatcaggacctcaggctgcccggggctcagagccctcctgggtcttcctggggcccctggtccacatgcatctccactaagcctgagggcccttcgggagaggcagcacttttagcctgcccttggttttagcttttgctctacgaagatcttgtgatttctgccccaccatggggcagcaggaacctcaagcacagtgcctgcggcaaagggagccacaatggacttgccccaggtcaggcctgcacttgccttgtgtcagggtatctccccaagttgctggcctcagtccctacactgacctgtttccccagctttatctctggcaccccaaactcagcagccccgaccccacttcccaagcaccccctgtgcctggctctgtgcctgtcatggtgtcctggcagcagtctgggagagtatttcagttacctgcggtgtcctgggaaggctggagcagaggggtccactcactgattgccaaggtcacagaacaggacttgcattgtgcactggaggccctgtggtcttgcatgagcctggtaggcctctcccctcctgcttccagccctccatctgggaggccagcctgcccagggctgctctgccacttagcagctgtgtggccctggagagtccctaacctcactgaacctcagtttctccgtttgtgaaatggagataatacaaagagaactttccttctcaggctgttgtgatgggtaaggaaataaatgcatgcaaaatcacagctgtagttactatgaggcacactgtcttcctggctagaggagattctgaaggtgggtggggcagcaagatcaccacgtgtatgaaatgggggcaggctggttggagactgagggcaccagccccaagcactgccatctgccctgtgatgggactctcctgtggcagtggcaacggtcccactgtggaagcaacacatgagctgagaggacttgcctgaactgagccacatgtgccctctgggcctggtcaccccaccacctgcccccagtgtgacccatgcagggcctgttcctgaccctgaacgagaccaggactccctgggctgcatttcctatctgtaaaattgtaggagggtggtggtggtgggggctcgaacttgccccctgggtggggtggggcataaatagtcccagaggatggcctgggaaggctggctgggcctggcacaggggactttactgctgtcattattgtcctccttacaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaacagaccctggtatgtgtggagagagggccgggaggaacctaggacaccggggaacctgaactcccccaaccagtgaagggagctgtgggcagcaaggtttgattggggttttctttcttgtggaggtttctcagagtgattcaagttcccccaccccgcccacagatggttctgagactttggaaagaaagaaaaggaaaaaagaccctgcccgcgccccagctgggcatccctgggaggtcgcgaggatccccggagacccagactcgggcccggggcgcccccggccagagcggcccctggctgcctccctacgccccgcgactccggtccggacgccgagggcctcggcctgcccctgtcccccggccgccccccacctgctccggcccggcggggcggtgctgggcccgcgggctccccggccgcagtgcaaacgcagcgccagacacgccccgcccgcgcctccccgcccccccgcgcccgcggccccaagcggttcccgagcccaggcccgcgccgagcccaggtgagcgcccgccccggggaccctggtccccggaaccccggtccccgcccgccgccccgcctcttcgccccggcgccgggggccagcgcttgcgctcccaagtctcggaccccggcccggcacgttaggggctgggggttggcaagcggggccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggacagaggcttgccctgagctccgtgggggaggggagagcgcggagcccccacactcgaaggcaggactgggatcagatgccacccctaggacgcctggaagccactgggagtccgatctgggcaggagcccttgggatgaggcagtgggggcaggtggcgagaggtggaggagtggggagaggaccctgcccagcctgcaccctgggggcgccaggagccctgggagggtcaggtggagcaggggccgctctgtgagatgggagtaatccagtcccgcctcacaggtcctggggtccctgggacagacacagactcctgctgggtggttagcactgggctctgctagaacttttctgcagtgggcagctcatgggcaaggaatagcactcgggcgctctgcactctgggggtccctcctgccctgcccctggcaaggacctttgcctttgagtggggtgactgggctccaagccgatctagcacacagtaggccgaaggcacaggggccccacccagtctccttcctggcccaggccctgggggattcaggtccctgggtactcgggaagggacagcacagcctgggcaggtccccagtggcaagaccaggtctgaccttttctgggatctgtggcccatcaggtgaggcctgaggtcagccaggaaggaagcgggcagggctgaaccagggctgaaaccaggacccaggaagggacagcctagtgcccagggaaggggcaggtggggcaggtggcagttgagttttacagaccttctttgatgacaagtgggggaaagagccaaggcacgccccagtggctgtgggagccaccgcctcctcccctgtaatgggcacctcgaggaccgacaggcgcaggggccaggcaccaagggtccctctccaacctggccttttgtttccaccccttgctctcaggcacccacccacggcccttcctggtatctggaccagaccaggtgggtctcagccccacctcaagtgagacttcaggaagaacttccagaggaaactggaggatggcagtgggatggactgtggggaggtcatttgcaaacaaggcagcttatgcctgtgccctgggccttccaaagtccacctgtaggctgcatcttccggaaggcccaccctgtagcctggaaggcacctggctacagtgatctctctgctgtgcaggtgtcccctcccccagggcaccttgcagggccttagggtgatatgggggctttctgggcccctgcccaccttaaaactgatcaaggtgggagggtggggtgggaggccacagggatgcccctgctgcttgaccttgatgggaccttgaccccttgctttccccatatgctgttgggcatgactgcccacaggcctggtgggcgtttgtgaagggctggagtcgggggtagggggagcttatggctgctgggcacaggcgtggcagggctgtgtgcctggcttccctttcccctaaccccatcaggcccgggctggccgcccacttctgttcaccacagagcagggtttccctggggaccagtggactggcccagccccacaccgccccccagcccctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtgggtgtccggagtgctagccagggtggggctgggctagggggagcctgatgtcacccccattgtaggagggagaagaccaaggatgagaagggctttggcttccccaaggtgaccccctctttgagcctaggcatagtggtctcccgggagaatggagggtcccagagctctcaggctgtgggatttggagaggggaaggggggcacgaggaggcagtagaaatcagggaggatttcctgggcaaggcagccgcggggctggacgatgggcggccgaggttcgggcagaggaactccactggaggagtgagggagctgagcttggagggcttcaaaggggaggtgacctccagggccccacgctctgggatcaggctcacgccatggttcccagctcaaatgtaagactctttccgaagctcccactgtctctctccgtccctctgtgtctctacctgcccacacgccccggtcctgatggctccagtctcccctgcaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggtacctcctgtcttcttgtctccatcctttctcctccctccccgcctcctcctcccccgtctcccccccctccccctctgcactcggtaggcctccgaagtaggtcaggctatccaagaacccgctcggaatgttaatacgctgccgccaggagggggtagggggcctggagcagttcccccagctggcccctgctccagtgggtgcccctttttctttggggctttgagtgttggtggtgggaataacagcaggacccttcttggaaaaggaaagtcagggttcctcctgttgcagggttggggaaggggctatgcccccagggccagggaaggggggagctggggacacgctcagccactctgtgacctagggcatgcaagttacccctctgagcctctgtttttctctctgcaaaagagagggcctggccaccctgacctcttagagttgctgtgagggtgtagtgggcagatcctggctctctttgcctcctctgatcccctgtgtggtctcgggctgccttcttggcctttctgggcacacttccccatttatacaggaaatcaccatccaacctagcctgagctactccagccagaagtgggagtgtcctggggtgctaggggaggcctgggtcttttctccactaaagactcatgtctgcggagctctccctctggccccccactttccctcttctctcctcacaacacctggggaggcaggagtgtgcagctttgtcacaggtggagaaactgaggcttagagagacctcaagagcgcagccagtgctccactcaacctgccaggccacgctgccccagccagctcaccccagccagctcaccccagccagctcaccccagctccccttacctgatacccatcagctccgttaccttggaacttgtgaggcttttctccctttcctgggtctaagggagaacttgggcgagggaggagggctgtgatgacccaccaggcagagggacccacttgcctctgctccaagaagccactcttcctcccccgctcctgtgctgtggacacctaggcctgggctggatccctctctgcctcaaaatgtgccttgggcagatgacgtccattgtctccccctagcagtgggtgggatgatgccagctggcctcataccaggcgtctgtggcaccgctgggctggcaggaggccctggcagaagatgccacctgcaggttcttttaaaggaccccaaatggctggcctgcctgggacccgtggccccaggacttccagtgtcgggggtggccaccctcaccaaaggcagtcctaagaacttaggcaaatccagccctgcccctttctggctgtgtggccttgggcaggtgatttcccctctctgagcctctgcatcctcattgtaaagtggggctgttgtgcctagcatgagggcctggcacaccagaagcacttgcggaattttttttttttgagacagagttcactccttctcccatgctggagtgcagtggcgtgatctcggctcactgcaagctccgcctcccaggttcatgccattctcctgcctcagcctcccaagtagctggaactacaggcgcccgccaccacgcccagctatttttttgtatttttagtagagacggggtttcaccgtgttagccaggatggtctctatctcctgaccttgtgatccgcccatctcggcctcccaaggaatattatttgttatcccttttctgagctgggctctgtgctgccaggcctcccctgtggggctgtagccagaggctcaggccccaggtgcccatgctgggcaggtcaggcatgaggctcagggaatttccagatatgggagtgacagcatttggggcctgagggttcagctggggtcttaaggggccacaaagagactagatcaagcagaagacctctgtgcaaatccttcactttctatcttgctccactcgattctgtggctccgtgtgcatcagcacctgcttcctgggttcccctctgtgctcctgtgtgtcctgtctgagtagttgataagaaggtatcagaccagtccctcacctagctcagagctaggaggaagtgcagctctcttagcatctgttcacctgccttttattaggccataactgatacctaaaggctttccatcctcaccatggctgctaggaggctcagagctaactggtaaaacactgctgcccaactccatctattgagcttctactctgggttacatacagtatttccttcagcattcactgtcaccaacgaggtaggcatttgctgttctctctgttttattttcattttttgagatggggtctcattctgttgcccaggttggagtaaagtcgcataatcatagctcgcagcaacctagaactcctgggctcaagtgatcctcccacctcctgagtagcagggactacaggcctgcaccaccacgactggcaattttatttatttttttaacttttttattttttgagagacaatctcactccctcacccaggctggagtgcaatggcttgatcttggctcactgcaacctccgcctcccaggttcaagcgattctcctgcctcaggctcccaagtagctgggattataagcgcatgccatcatgcctggctaatttttatatttttagtagagactgggttttgccatgttggccaggctggtctcgaactcctgacctcaagtgatctgcctgcctcggcctctcaaagtgctgggattacaggcatgagccatcattcccggccaactggcaatttttaaattttttgtagagactgcatctcaccctgttgcccaggctggtcttgaactcctggactcaagcgatcctcctgccttggcctcccaaagtgttgggattacaggcatgagccaccacacctggccttctctccattttataataaaggcatcttaaggcccaaaggggctaaggcaggtcttatgggcagccagaagtcatggagctggggctgatccagttttgtgggtgagcagagacgcctctcccctctacctttccaaagggcccctgacttaatggcttccattagactgcatcagtgagtgggcttggagccttctgggaggaggtggaggatgagagcagcctggcttggcattatctggcccccctgccaggctatttgtgagctcccacagcttccacagctggtgtcagctaagtccaaagtatttctctttttaattcttccaaaaacattctaacaccattacataaggtatagaaaatggaatgaaagccccacccataaccccccacctgatacgatggcctcagtgtggctctgtgctctgcatcctccctgctgggctggggtcaaggaactgaccttttctttgcccctgtgccctgctatgcctgggcctgagctgagggctgggacttggggctggggaggggacctggccagcgtggaggatttagcagagcatgagatgatggatgggctgggcagccaggagaggcaactcctgagccttgtctgggtagataggaaggatggcagccccagcccaggggacagctcaggcaaaggcctggaggtgcatctcggcagcctctctgggttcttggtttctggagtgtcagttctgaggtggaagggatgagaggtaaaacccagaggtgctggtgccttgggaagtgagagaggtacctcctgctccagcatcgggcccatgctgtgccaggggcttagtgtccatcactcagcttcctccctgcagcagcagcctgggaggccagattattgctgctaaaaattctgtttattgttcccttctaattagaaaaatatcccaggcacatcacagggaatttggaaaatgtgcaaaagtataaagaagaaaatggcaatctctggctcactccccgctagagctggccccgtgggcacgctggggaagtggctctgtatggaggctgtggggggggggggctgtgccccctctgtgccatccacatgcattcccatgctcaggttcacccccagggcacacgaggacactgaaaacccagcacctggttagtgatgaaggattctcaaattggtgagaagagctattttgagaagttgaaatcgggccgggagtggtggcccacgcctgtaatcccagcattttgggaggccgaagcgggtggatcacctgaggtcaggagttcgagaccagcctgaccaacatggagccctgtctctactaaaaatacaaaaattagtcaggtgtggtggcacacgcctgtaatcccagctgctcaagaggttgaggcaggagaatcgcttgaacctgggagggggaagttgcagtgagccaagatcgcaccattgcactccagcctgggcaacaacagcgaaactccatctcaaaaaaaaaaaaaaaagaagaagttgaaattatgctgtgaattatgctgtgtacattttttttaatttttgaaaaaaattcaaatatatgggaaagttgtaagactagaacaatgaacccttgacttcctgtcacccagattcactggctgggaactgagctgctgccacttttgaattcctgtatgtacatgagtcataccctgagatgtcagggacattgtcattgtccatcagaagatgcaggactgtagggcctcagggttctttctgccacagaggtttctgcagccaggagaactgcagggtcgaaggaactcagctctgtgtccccctcactaacactgtaattgaaaaaggaggcggggtgtggtagctcaagcctgtaatcccagcactttgggaggctgaggcgggcagatcacttgaggtcaggagtttgagaccagcctggccaacatggcaaaaccctgtctctaccaaccctgtcacgccacacctctggcgtggtggtatgcacatgaagtcccagctactggggaggctgagatgggagaatcacttgaacccaggaggcagagactgcagcgagccgagattgcatgactgcactacagcttgggcgacagagtgagaccctgtctcaaaaaaaaaaagaaaaaagagacatgcagaaacgaattcaagcagacccgggagcacccccacccatccatgcccctccgctgcttcgtgccaggtttaaggctctttgctgggctggtggtgcagagggaattctggggaggttgccaggcagggctgagcctcctggcaccccgaggagctggcctctgcacccagcttgagggatgggggaggaagttggctgaggtggggggctcaaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagtgggttctgggcttgcctgggagcggggatcaggggtcccaaggtgggagggtgagggggccatagccgggggtcggggttggcctgaaggggctatgaccagctgctgccctggtcactgcctttgtggcttctaccggtctgggcctgctccccagaaggctggacactgggaggagctgccaggaggttgtgcctggtgtctggcctgacctctgagtgctgcggttccccaggatgcgggaagtggagctgggctgggggaaggtgttgctggtgaaggacaatggggagttccacgccctgggccataagtgtccgcactacggcgcacccctggtgaaaggtgagctgtcaggtgggaggcgtgagggggaccttccaggccccatgccagcttggctcctccccagaccccaggatcttcatctattagtgaagtctcctgggctgtggggaggggcccgcagttgccggggcactgagatccttgggaagcaacccctgctggtgggcgcagcctaacacctccccttcccaggcgttctgtcccgtggtcgggtgcgctgcccctggcacggcgcctgcttcaacatcagcactggggacctggaggacttccctggcctggacagtctacacaagttccaggtggggccaggagtgcgatggggtgggaacctgggggtgtggggttcggggctggtcctgagcaatgcagcccttgcaggtgaagattgagaaggagaaggtgtacgtccgggccagcaagcaggtgaggggatagctcggggctcaggcagaagggaggagccgggagggcatcttggcccagagaatgccatgtgcaaagccctgtggtgggaggagcttggcacgtgtcactggagcagagtgaggggttgcggtagggatgaggctgggctggagcgccaggacctgcctgccaggatgatggcatgcagaggatggcagtgaccctccaccctcctggcacccacaggccctacagctgcagcgaaggaccaaggtgatggccaagtgtatctctccaagtgctgggtacagcagtagcaccaatgtgctcattgtgggtgcaggttggtagtggggtcatgaggggcagggtgggagatgggattggtgagaagtggttcctggcccacgggcccctcccctcaggtgcagctggcctggtgtgtgcagagacactgcggcaggagggcttctccgaccggatcgtcctgtgcacgctagaccggcaccttccctacgaccgtcccaagctcagcaaggtacagggggtggggcaagtagggaccctatccctctgggtcccagttaagcccacttcaagccttgcttgtcaccccattggggtctggccggctgccctccctgcttatgccaggcctgtccgtggtacccccaaaagatctagatttgttgttgttgttttgagacagggtctcactctgtcgcccaggctgggatgcagtggcgccttctcggctcactgcaacttccacctcctgggttcaagcgattctcatgcttcagccttccgagtagctgggattacaggtgtgcaccaccaccatgcctggctaattttttgtatttttagtagagatggggtttcaccatgttgcccagaccagtcttgaactcctgagctcagcccatccgcccacctcagcctcccaaggtgctaggattacaggtgtgagccactgcacctggcttttctttttttgagacagagtcttgctctgtcactcaggctggagagcagtgcctgtctcacggctcactgcagcgtcgacctccacctcccgggctcaaacgatcctcccacctctgcctcccgggtagctaggactacaggcgcgcaccaccatgcctggctaatattttgtattttttgtagaaatgaggtcatttttgtcatgctgcccaggctggtcttgaactcctggttcaagcgatcctcctgtctcagcctcccaaagtgttgggatcacaggcatgagtcactgcgcctggccagatctgggtttgctgagttctgtcctgcagcccctatgtgactggggctggccccaccttccctgggccccagtgtcttctgctgtaaactggctcctctcaagctggctctcccctgcagtccctggacacacagcctgagcagctggccctgaggcccaaggagtttttccgagcctatggcatcgaggtgctcaccgaggctcaggtacagggtcaagggtgggaaacaggcccgaggagggaaggtgggaaccgtgaggttgtgtgggcccctggggtggggtcttggtgctctaccttcctggccccacagcccaggcacctgggaggtgctccaggcttgggagacagcaaggagctttttcctgatgggtcataggcacacacagagccccacggtgtgtggagatgaacgatcagggctggataggagatactggtgggacttgggagggtaaggagaggtttgaggggaaggtgatgtctgaagcgtaaagaatgaagcccaggtggcaggatctgttttaatgggagcttctcagaggctgtggctgggctgtgggtgtactgcaggaccggggagtgggcggcgaggcccagccccatgcccaagctcatgctctgcctggtggggattgcaggtggtcacagtggacgtgagaactaagaaggtcgtgttcaaggatggcttcaagctggagtacagcaagctgctgctggcaccagggagcaggtgggagggtctcctttttacccatcggacactaggcagggcactggcctggacggggctggggctgccaggaggccctcactgacacggccatgtctcagccccaagactctgagctgcaaaggcaaagaagtggagaacgtgttcactatccggacgccagaggatgccaatcgcgtggtgaggctggcccgaggccgcaacgtggtcgtcgtgggagccggcttcctgggtgagaggtagtgggcagtggagatggtggtcaggtcgtcatggccagtcccagggaagttctggtcgaggaaggtgcaggtgccagcctgccaccccctgcccatcaccagggatggaggtggccgcttacctgacggagaaggcccactctgtgtctgtggtggagctggaggagacgcccttcaggaggttcctgggggagcgcgtgggtcgagccctcatgaaggtgagcccaccccagcacccagtgccttggagccctggggcccagcccggcccctggctgggctctcatccaccgcccacctgcccacttgccctgacagatgtttgagaacaaccgggtgaagttctacatgcagacggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagcccagccgtctgcacatgctcacatgtgaccttgggctagtcccttcccctcccagagcctcagtttccaccacatctgtcaaatgggaacccccaaccgcccccactttacggagctgttggggaaggtatgtactgggctcagcccaggcctggcacagtggatgctcccagtgcccgctgcccagtaacactcatctccatgccctgcgagagttgacatagacgagactcgaactggcttctgctccagctgaagtgccaatttgggtaggggccaagatgggaggtggtagcacctgcaggggctgaggaggtatggcatgctgtccctccacttaagggcctcatggagcacttcttggagaaggtgatatctgaggtcttgcgggaggcaccgggtctgtgggagaccgggtagtggggaccagggtgcatgaaggcctcaggtagacagcccctggaggatcagtctggggctggcacatcaagcgcatgctgtagggtgtggagagtgactacgcagaaggcagggacaggggagtggacacaggcttccgtcctgtcaggtgcagtgcccgccacaggcttcctgaggcaaagcggcatcggtttggattcccgaggcttcatccctgtcaacaaggtggggtggatggcactgggtggggaggacccggtgctgggctgggagtggcaggaggttcaggtcagggcccctgtcacacccatggagctctgggccctctctctacagatgatgcagaccaatgtcccaggcgtgtttgcagctggcgatgctgtcaccttcccccttgcctggaggaacaaccgcaaagtgaacattccacattggcagatggctcatgctcagggtatggccagtcccgaggcacatggaggggtgggagggagtctcagggtctcagtgtccccatgcccatgcctcagttgctgaccttgggtcctggacactgttaggcatcaaagctctgatgtggattctctggccagcctcatctcggcgatccagccaacacagagagcgacaccccactgagccagccatagctcctcaatctcagttttccttctggtagtctctcccttttttgtcttcaaggacatatattctgcagaattcctgatcaacctgtgcattaccctggggagggagggagggatttagtggatcaccttcccatttatgcctctgtttcccttgggccactcaagtatctctgtgaactcagttcagcctcatgcaggtccccgaggtgccatctgagcccagagacgtgggctcagtggaggcactgtgctttctgaggaatagctttcccctcctgatgtttgctggccaccaagtcccccaagcctcatccactgtgcacatctggtctgggcccctaagctgcaggtgccatcacattagttgcctcactgcctcagagagaggactgccagactcccagcctgggacaaaggacttctctgcacccatctcccctttcctctgcctttacacctgagggtctgctgcttgaaaccccacttctggtaccaatttctattcaagtccaaagtcgaaagttgttgctaggttgtaagtaaccaaggcaacttatcagccaagtataattaggatttaactgagagagtttaggggactttgaagtacatccaactacaggggtctactggggcctcataggaactggggagccatccacactggtctctttggggccttgtgtgtggctgtcatctgtgcttccctgtgtacttgtgccccattttcctccctcttcagacctgatacgtctgattaggtgtctgtgtgcacagctgaaatggtggcgtactcccccaaccccaagaagcagaccttccagagtcagggcactttattcagattctttaaggaagcaatcaagtggctagctttgaggcaggtgttcccctgcaccagtcagctgcaggtgcaagtgagcagtgggctgaacaatgatgtctcttgacctctggggagaccaggaggagtagccacacgtgtcaggggtccccagggcatcaggagcaggtagtgtgggagtggtaagagcgagagttagggttctcacggccctgggtcccgcagggcgcgtggcagcccagaacatgttggcgcaggaggcggagatgagcactgtgccctacctctggaccgccatgtttggcaagagcctgcgctacgcgggtaaccccggggcctcggatgggggcggggccgagggcgtttaggggcggggcttgggtgtggggcggggctgggagcctaggggcagggctatgaccgcactaggaagaggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttggcgcgaagcagcgggagctcagtcgggaagggggattcatcccaggcaaaatcccagaacaagagcccagccctgagccccgctgaggagtgctggagcttccttaggaaagcccgaagcttgtgcacggtcaagccgcgatgtgcaaagcagggagggctgggtgctcaggccattcttgttgccctggggtaggtccttccctgggccccagatggacagcagtgcatcagggttttcaaaaaggggctgctgcctcgcagtcctcaggcttggccatcctctccttgcagaggcgacgaggtgatcgccgtggccagcatgaactacgatcccattgtgtccaaggtcgctgaggtgctggcctcaggccgtgccatccggaagcgggaggtggagtgagtgtgggtgtgggaagcctgggggtgggagtagttccctggagtactggctaaggtgcctatgacagccagccgcccccacaaccctccagggcctttcccctcttggtttgcatcgcctgaggcttacaggactacagggaggtgtggggcaaggatcatggtttgagagcaggctggttatgtgttcatggtggatggaagggatagagatgtgtgtcaccaggcagggccagtgctgtgggaaggggtcagggcccaatgcatgggcaatcaccaggcgtgggacacctaactggacatagttgtgctgagcctggcagaagctaggtgggaaatgcagctactgatgccctgggtatgccctccacatagatggtgggggtggttctaggtttcactcaacaccagccagttcccttatcctggtgtggtgtcaatgagattcaccctctgggagagagctcccagggactggggacagcctggaggccactgggaggctatgagacaggggcaggcttcaggctggaaacaatggaggaccagaaggggacatgataaatgacatgctctctccttggccttctctccgtttctctctcttgccttcgtgaaggctgtttgtgctgcacagcaagtacgtgtgtccttcatgttgaccgttctgagcctttcccatgtcagcccagaccctccacccaatggtcttatctccctctgtccaagtacacctccctgctgggcactagggtctggcacagaacagaccccctgctgtcctcaagggccagctgttcagggtgcccagagtggagagcctgttttcttctgtcttgacccctcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatctgtatgactcccagtgtaattgggccaataggcacaggaccagaccacagggaaacaggcacaatcacagaatgccaggtgccacaccaaggaaatttggcctgtgaacgcccagaggaggtagcaactaattctgcgccccaagccctcccacatccctctccccctctgcgatcagcgaacgctttttgcttttggctctgagttttgaaggaagggtattccaggtagaagggacaacatgcccaaaggtcttgagatagtaaatgctccttcagaggtggctcatgcttgacactttggggcatttgcccacttagggctgtgggagctgtgtcctgagacagaccccatgcttttcatagccggagcattctcaatccccatgtcggaggtgaaggagctgaggccctgctaagtaggaatgagaatccagaggctcctcgccgggctgcctctcagtcagtaagaaagccaaggggagaggggagttgctgggggtcagggctgagggcgctagcaggaaagggagcgttgagccgcctgcagaggccgctgcgagcccggaaccctccatgggggatcccggcagcggcagacgatccaggccggagccacgcgcagacccagggcatgccgggaactgcgagccggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggtgggcttcatggggtcctgaggacaggaagggcgatctgcgagggtcccagggcgggtccaggggcgaagccggggggtggtgtcctggggtaggatctggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtacggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtccctcttctgagtagatgcagccttgaaagaaacacaaccacccttgcggccagccctgccaggcacttttctttccctgtgcctcatcggtatggaggacacagttttatttatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggggtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccttttaccattgtatcctggcatctagaaaactccataaatgtttgtcaaatgaaggaatgaaatgaagaagagatgcctacccacaagcatttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaaggagggggggggggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcactgggctcctgtcagtttgcccttcttcccaagggctgggtagtgatatgccagctggtagtgttaggtggtgcaatggccagtgaatttgttttctatttgattgtatggcttttgcaacaaagaaatggcaggggccaggtgcagtggctcacacctgtaatcccagcactttgggaggctgaggtgggaagatcacttgaggccaggcattcaagacgagcctgggcaggaaagcaagacttcgtttctatttttttttttttttttttgagatggagtcttgctctgtcacccaggctggtgttcagtggcgccatcttggctcactgcaacctctgcctcccgggttcaagcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagctgcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagaaagaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggagaggtgtgcagggaagacctcaaggtgttgccagaggttttctggtaatgggaatttgcatgagctttagtgcctattttgttttttccttattggtgattttttttttttaagtttctatgatgagacaggtatcaccttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggggctctctctccacccgtggctttgtctgccagtcttcggaattctgcgctggatctgggaccccttgccctaacggccctgagctcacagggttgggtgtctttctgtgttactgagctgtggctgggaacagtgtcctgctcatctctgtgtccccagagcccagcacagaggcagacaggcagcaggtcgttccggggcttgtggaaggagtcctggcttatgcattttcaggggggccagattctgctccaccttccagggtttgaaatctccaagactgccctttgggtttgacagtttctcactctctttactcagggggttacactggggacatttattccaattctaacttgaagaataaaaacgacctctttgaatacaagtttgcaactggccagtggacggagtggaaaattgaaggacggtgagaaactttgcagaaacatttgggacaggctgggtcctgggtggcattggacctgggatctgcccccttttgcctcccagatgaggaccctgagggcacgcaatagcagggagcttgggattggtggaatatcccccggtgcagctatgcatggcctgctcccagcccttagactccctcctttcagaagagacccaaatggaccaggcgtggtggcgcatgcctgtagtcctagtactttgggaagccgaggtgggaagatcacttgagcccatgacttcaaggctgcagtgaaccatgtgtgccccactgcactccagcctgggagacagaacaagaccttgtcacaaaaaaatgttcaataagatccaatgtactgctgatggcgcttctggggtcccgctttttgagcaccccctttgatattttgggggcacctaggagaaggttctgtgcctctgtggctgtctgaattcctcttcaagccactagtcggcctctggggctgttgtttattcctagtgccttgtggaggtcctgaagccccagtgtcgggtggatgtagccatgcagcctggctgtggcccctgcactgaccacatggggctgggtggctcaggtctgtgctgggcggcctcactccctcccctcttccctcacactccaggttgccagtcgctaggtcagcccatggggccacggtgtacagtgacaagctgtggatctttgctggctatgacggcaacgccaggtgggtggtggtccggcctgtgcaccccacctccgacagcactgagacccggagcaggccgtcctggcatttgagggcttaggctgggaggattttgagtgcctggtggattttgagtgccactctgtctgggggtttcttgggagggggatggggaaagaggaggatggacagatggaggtgagggccactgggtggagccccgtggctaccagagtagcttggatgaggatcctcagccaggagttgccctgcggagctgagttggtgggcgggtgggcggtgcccaggctcaggcccagccctggttcttgcccaggccaaaggccttttcctccttattttagaaagttggctttgctctctttttctgatcacaaaagtagcatatgctggtttcccaaaacttcagcatcatagaaactcctaacgatgcagtgatggtggcatctgggatatctgtgtcctctccccacccaggagggacactgagtgaggagctggcactgccacactgccctgatgtcatgcatgagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggcgcaggtagaggaggtgaggggcacggggagccagggcgcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgtcctgctccctggagctccccctgggcttgctttcccctttagaaacatggaatttatttatttattcattaaaaaaaattgtttttcagtcttctgggcatgaaaaacatgagtttagcccctgatgatttaaccctgacgattttaaccccagctgttcacaactgggccccgtgaagtggatgagacagggctatgagctgttccaagacaaaggaatctgtgaatcctcatctggggaagtttcaagaataaaagcagtcccatctcagcagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccatggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggtgagggtgcccaggggtgtcctgacctgccagctggacaccagtagctcctaccctgctcccacccagctcctcacagctttggggccccctggggttccagacagctaccaggagcaaggccaggacacctgggcctcagccctggacacctgccccggcctccagccccagcttcaccccacagcctgcaggtagttaacgcttcacaccccatcatggctgcatggggctgctgtgctgcagacctttcctgggaagcccacggccatgcagctcttccttctttcagaacccactctcaaggccaggatggtgggggtctctgggcacctacctggcccttgccaactggtctcatgcccatgtgtctcccctcttcaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacacctctcacacatggggagactgaggccccgagaaatacttgcttggggtcacaccacaaagggggtacagggccaagggccctcaccctgctggccaggctgcagctttctggggtgggtgccacacactggcccaagtgccctgaccactctgagggtctccatggcccgtcatgccccactcgcctacatgggtaccaggtcccacctgtgtctgtacccaggggccctcatcccttggggaccctgccccctggcccttcatggccatgaggtgccgcatccttgccttacctggctgcaccagccgcactgtggaggctctgctcccccaccattccaccctgccttcttgtcccccagctgcccagtgggaggctcttccacgcggctgctgtcatctcggacgccatgtacatcttcgggggcacggtggacaacaacatccgcagcggggagatgtacaggttccaggtgtggggcctgtgggcctgtagagccggctgggtggacggatcccccgtgatgagaaactgaggccaagttggggggcagggcttatccaggccattgccagggccacacctggcaggatggaagccttgggaggagccctgtgggctgagggtgggctgaggtggcactaaagtgggcagccttcgtgcagtggggcaggcagatggtgctggggctcacggcagagtcagtggagggagccgggccaagctgggctcagcaccagagcctcacaggcatcatagcctggcccagggcagagccagggccgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgcttcctctcctcagccaggcccacctgcctcctgggccctgagggtcagcatgggccaggtggggacctcagggtcggcctgcacagccacactggggccaccctgctgtctgcaacatctagtctcactgggcccctcttgcagttctcctgttaccctaaatgcacgctgcacgaggactacgggcggctgtgggagagccgccagttctgcgacgtggagttcgtgctgggtgaggtgggtgcctgtcctcgcaccctgctctgcctgctgtgcctgggcagtgggaatttcgcccctcagaaaaacagctgctggcctggtggtgctgaccttggctggctgggtctctgttctctggggcgagggtcctgtgccctctgccagtgcatcattctttgtgcagaaggaggagtgcgtgcagggccacgtagccattgtcacagcgcggagccgctggcttcgcaggaagatcacgcaggcgcgggagaggctggcccaggtgaggtgcctaaccgccctgccctgacctggcagccatgcctggtgtccactggggtgtccttgagctcccttctccccacagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggtccgcctgggtgggggtggagcagggttggtgtgggctggggtgcgggcagcagagccaaaaggtgggtgctgccagccctgccttactgatgggccccctgaggctcagaggctgcaggtcaccctccttacccatgatcactgcagctggacgccatctgagtcccccgaggccttgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcaatcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcaggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcatgctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacgaaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaatagagatggtagtgaagggggcggggagagggttgtccagcttacccaccaggctgatggggcctgtggacagaagcctgtcatgctcctgcttgagaaccggatctagactgggttttagaagtgttctcaaaggggctggctggtttaagtcagggctgtttcagatcctatggaaagggcgcctggagctgtcttcctggcccctactcacaccatcctgccccttcagagaaccctgtggggcacggagctgcgctagcagggctgactgccacctgtctaccagtagctctgaggggtgagagccaggctccctgttctccttggcaaagagcttggactgagccctctaggagctgcagccactgtctggggcagcaagcttagtactcagaggggctccagcccccagctgagccagacagcaggccctccgtctagaatccgctttattatggcacctggtgggtctggtgggatctgagggaggaagaggctgcagtcttgctgggcagcccctcggtcagtccagcagcccctcaggccatgctgctgctcagctgcatggcaaagtcctgcacatgctccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagactggccgtggttcgagaggggagggctgccgctctggtgaaggctgggcgctgcagcctgcttcatctgcctgggcacccaaggggcccagtaggtctgaaaaggggctgctaaggccaggctccagcctcccagctggggaggccggcaaagtggcaggtgctgaggcctcttccacaggaaagcaggtgacatcagcaggtggaggtggagaaaatggagttgtgggccctcggccctcggagcagctggtaagggggaagagagagactgatgggctaggctgagggcttgccagacccccctccaccagcccacctgatccacccttaacacccaaacccgatccacaggttctgtgtagcaagaaccctgtccagcgagactgctggcagacacccctagggcccagtccctcagcctaggggtgggagtggggcatcccccacccatatcacataccgcttcctgcatcgtctgagccggctgacttcagcggggccaggtgggtaactgtgtcctttggtcttggttgtccggcgcaacttggagaaagactcaaatatggtggggactgccccctcctttagcctgtgatatccactgcggggaaaagcaacccagatgagctggagagcaagtgctgcctccccaggccaatctgcccccagcagcagcgccgtgggatgctggaaggcatcgtgcaaacaatacgtctggggaacgccaagttacagctacaccaatcgcttccccgcaggactcctcacagtccaggtgtgtggaaagcctgcataagccgagctgggctgaccagccagaaagaattctttgatttgtggacttgctggcaagactggggctctgaaagatactctctggaaaggctcctgttttccccttgtgtcacaggcacagtgatcctgggggtgggtttcactgtgcagagctgggaacaggaaacagcccccttggacgcaggctgctcaagggacttccatgacctgcagctgtcccagtccgccgggagccccacatcctaccccagcgtcggccggcagggaggcccacctgattcccaccagctcaaagcagtcctcctcaaagtgtttggagcagaagtagatgtactcggatgccgggtcccacaggccctggccgctggggtccagccgctggcagttggccagccacaagcctcgcctcgggttgtccttcttgggaagtctgtggagccacaaacccgtgagcaccaggctgtccacagccctgggctcatgctgcccaagcaccccagaggggaaacgcagacccaacacgcgccgccacgagacctccctgcgaccccgccgggtaagcaccaccgcccgggcacagacgaggcaacggaggcctcgagaagaaaagcagtttcctcagcgtcatctggcaggtaacagagtggggcgggtccaagccggctagacttcccgtcctccccttcccgactgcattcagtcccgccgggaccgttccgcttcacctcccacccacaggttcaagcctcctcagtatctgagaaaggcgcgaagcctctacgcagttgcgacccgaggcgagcaacaactagcgcatgcgcacgtgagcccgcggcgcacgcgcgctgacctgtggaaggagatgccgcggttgcgcgtctcgcgcgtgtcccgtgtgcagcagccggcggcggagcagtgacgcggcatctgggaaagaggcgggagttaagtcgcaagcggctctccgggcatccggaggagcctcgcgcctccagccgccgctcctccccaaggggctctggcctgtcgggtcccccccggcccgttgtcgccccaaccccgtcccagccgattctcttgacttctgtcagcggcactcacgctctggccattgctgcgccgccgaagtctcgcgaggggtagcgcgcgccggaagttggtaccatagagactggagagccggaggtgcccccgccaccggggcggggcggggcgaggtcctagctagctgggttagtaagcggcgcgagcgtgcgagtttctgacgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgcaaactccgcctcccgggttcacgccattcggctgcctcaccctccacagtagctgggactacaagcgcccgccaccacgcccggctaatttgcaatacggaaattttaataggtaattagctctcctagcgttatggtggggaatacagagggatggttgcctgccgcaccctcccctcactattcttcgccttcttcagcctcagcttccacggaatccatgcccacatcttcataatcctccagagctgccagatcctcgcgggcctcggagaattcccccactgccatgccctcccccacgtaccagtgcactaaggcgcacttggccgaacttatggtccaggcaggcccaggcctccgtgatggccgtggtgttgctcagcatgcacaccgcccgctgcactttggccaggtctcccacagggaccaccgtggggggctggtagttaatgcccacctgtcagagatgggcagcatagaatgaagtttatattggcctcagaaatgggagctcattaaaaatcagagctgtggaccagttccaacactgtgttttaagaattgcttctatattttttggcattatctgttatctatcgacaattaatatcctttgacgacttttttttttcttttcttctccttcttcctccttctcctccttctttgttgttgttgttgagacagggtctagctctgttgcccaggctggagtgcagtggtgcaatctcggctcactgcaacctttgtctcccaggttcaagcaattctcctacctcagcgtcctgagtagctgggattatgggcatgtaagatggagcccggaagacggagatttcagtgagctgagatttcgccactgcactccagcctgggctacagagcgagactctgtctcagaaaaaaaaaaaaattattacccatattacccatacagtaaaacacatgaaaaagaatgagaaccctgtcttgggatataaatacatccaaggtatattgtatactttgtaaaaagaaaagtgagttgaagtctatgtatttatgtgtaaaaaaatccatgtaataacatacacaggctagaaccttgggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctcactctgtcacccagccttgagtgcagtggtgtgatcttggctcactgcaacctctgcctcctgggttcaagcgattttcccactttaagtgatccgcctgcatcagcctcccaaagtattgggattacaggtgtgagccaccgcgcccggcccatatcaagttttttttttttttttttttttttttttttttttttttttttttttgagatggagtcttgctctgtcattcaggctggagtgcagtggcacaatctcggctcactgcaacctccacctcctgggttcaagcaattctcctgcctcagcctccagagtagctggaattacaggcaaccgccaccatgcctgactaatttttgtatttttagtagagatagggtttcaccatgttggccaggctggtcttgaactcctgacctccggtgatccgcctaccttggcctcccagaatgctgggattataggcgtgagccactgaccgcacccagctttttttttttttttttttttgagatgggttttgctctgtcgcccaggttagagtgaagtacaatggtgccatcttggctcactgcagcctcaacctcccgggcttaagcagtcctcctgtctcagcctcctgagtagctagcactacaggaaatgtgccaccatgcccagctaattttttattttttgtagagacaggttttgccacgttgcccaggctggtctcaaagtcctgggctcaagccatccacccaatggattacaggtgtgagacactgtgcctggccaacataagtacttttataataaaaaacccaaatgttcgtatttttttttctaagggtcttgttctgtcacccaggctggagtgcagtggcgcagtcatggctcactgcaacatctgcctcccagtctcaggtgatcctcctacctcagcctcccaagtaactggaactataggtgtgtgccatcacacccggctaattttttgtattttgtgtagagatggggtttcaccatgttcccccaatggatcctgaactcctggactcaagcttttttttttttttttggtgagagagggtctcacttggtcacccagcctggagtgcagtggtgcaatcttggctcactgcaacctccacctcctaggctcaagtgatcctcccacctcagccttccaagtagctataagtgcgtggcatcatgcccggctaattttttgtatttttggtagagatgaggtttcaccatgttgcctaggctggtctcgaactcctaagctcaggtgatccaccgacctcagcctcccaaagtgttgggattacaggcatgagccactcggtccagcccccaaatgtttttaagcatggaaaagactcttcgaaaatagcatatccgaagctgggtgcagtgactcacgcctgtgattccagcacttcgggaggccaaggcggttggatcacttgagttcaggagctcgagaccagcttagccaacatggtgaaaccctgtgtctaccaaaaatacaaaaattagccaggcttggtggcgcatgcctgtaattccagctgcttgagaggctgagacaggagaattgcttgaacctgggaggcggaggttgcagtgtgttccattgtactccagcctgggtgacagggcgagactccatctcaaacaaacaaacaaaaaaaaagcaaatggttgttaaagaatgtatggttggctgggtgcggtggctcacacctgtaatcccagcattttgggaggccaaggcggatggatcaactgaggtcaggagttcaagaccagcctgcccaacacggtgaaacctcatctctactaaaaatacaaaaaattggtcaggcgtggtggctcatgcctgtaatcccagcactttgggaggccgaggcgggcggatcactaggtcaggagatcaagaccatcctggctaacacggtgaaaccccggctctactaaaaaataaaaaaaaaaaaaaaaaaaacgttagccaggcgcgatggcgggcacctgtagtcccagctactcgggaggctgaagcaggagaatggcatgaaccccggaggcggagcttgcagtgagctgagattgtgccactgcactccagcctgggcgacagagcaagactctgtctcaaaaaaaaaaaaaaaaaatagccaggcatggtggcgggcgcctgtaatcccagctactcaggaggctgagtcaggagaattgcttgaaccggggaggcagaggctgcagtgagccgagatcacatcactgcactccagcctgagtgacaagagtgaaactccgtctcaaaacaaacaaacaaacaagaatgtatggtaaatcacactaagactgacaaaaaggaacttaagagcaaagagaattaattcaacaaggtccatctaaggctggactatcttctggggggaggagaggctgtgactttatctccccacagactagcctccctactgtctcacaatacttagttacaataggaaacctctgcacagcatagcatctcccacagtgcctgccagctaaggatgtcttcaccttccaaatgtaacactaattgaaagaaaaattcctctactcaagttgagaggcttaataattagacacagaatggagggtttcacctcctacctgtaacatcttacatctaaggtctgtaatcctcctatgtaacatgtaatgaacattccaggttggtgtaactgttgtagattttacccttctttttcctcttttttttttttttttttttttttgagacagtcacgctctgttgcccaggttggagtacagtggtgatcttggctcactgcaatctctgcctccctgtctcaagcgatcctcccacctccacctccccattagctatgactgcaggcatgcacaaccatacctggataatttttatatcttttgtagagacagggtcgcactatgttgcccaggctggtcttgaactcctgggttcaagcaatcttctcacctgggcttctcaaagtgctgggattacaggcatgtgtcactgagcctggccgattttaccctgttctatgaatcactttaaatctgtcaacttaaagatggtttgcatcaacgtgagatgaaaaagagagatgatctgtgtcaaggtgttgtaaagtggctgagagagggccagacagattcaagaagttgtgtgcgttcagaggcaagttatggccattccacatgggaaaaagaagacacatacctgtgactttctcatatcatttcaatctggaatgatcctggaacttgcaactcctcaaacaccttcagaactcattgagacttataaatgtgggatctatagctttgcctaatgtgggaaaccactgtagacaggggctcttaactaaccatagggcacaaagttgaccaacacaggtgtggtgaggcatttagcctagtcatcacaacagatcttcgagcctgacattctgttatttggcttccaaatacatggtacttttcttttggtagacaactgactgtaagcatagctaaaggagcaccaaatcatcagtctgattgtgtgtgaggcagaggtctctgcttggtttggagaaagggcaaagacctgcctttggtcttcacagtaaacactgcacaatatatttaaaaatctttacagaaatattagtgttgcccaaaattcagtgacaacaggtgaccaagatgatgtaaagtgtaaaaaccactatttataacacaaaaaatgataacatagaacctgacaaattactaaagtgagcagtggagtaatgtggaggacagaccaggacctgcagtcagataatctctgatttctctctgcatcacttgctgcctgtgaggctccagacacctaaagctatctcagcctttgttttcttttcttttttctttttctttcttttttttttttttgagatgtagtctcgctctgttgcccaggctggagtgcagtggtgcaatctcgactcactgcaagctctgcctcccgggttcacgccatcctcctgcctcagcctcccgaatagctgggaccacaggtgtctgccaccacacccggctaattttttgtattttttagtagagccggggtttcaccgtgttagccaggatggtctcaatctcctgacctcgtgatctgcctgccttggcctcccaaagtgctgggattacaggcatgagccaccgtgcccagcctcagcctctgttttctaaagtgtaagatactggtaatattgccccatgaactttaaagggtagtggttaaggtatgagggaacataaagtatttggtaaagtataaggcggtaggaaataaattactaaaattattatccttgcaacctagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactcccagtagtaatttttttagaagacaaactgcttctctggcagttacactccagggccaattctcaaaggccaagtctggtgccaccccactccctctaagctgcttgagccagatgagagcttctgaaatgctgcagaaaagagctctcctggggcatccattaaaatgcagattcactggcattcccctaagagtttggttcagcaggtccagggtcaacatctgcatgcctcacccagggtcacaggtgattgttactattattggaccatttgaggagaggcaggtagaagtgcaaattcctggcaaagcaaacactcaggggcatgagagtgatgagaccaaggaatcccaaccatgtcttctacctcacctggaacaaaatctataccctttttgccacggcctacagccctgcagccctctgccctctccaccccacagcctggccacgcttccctggctccctagcctaggcacactgctgtctgccagtctgggaaacaggcccgcatgctcactgttcctctgcttgaaatgctctccctctgatcttgccatggctgactccttcccaccctgcacatttcagcttaaatgtcacctcacagaggcctccccagccacctctttaaagcagggggtccccattcttctctagaagcataaactatttgtttcttttgcagtgccaataattactcagaatgatattgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcattacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccaacaggtccacatctgggggacggagccactcctcagccagtgggatgcaaagccaggtaccacccccctcccccctcttctgccatcccccaaacctccaggtctgaggcagaggaaaaggacttacaggttaactgtcctggggttgcatggtggctctggctcccaatggctgggtcccctctgcccctgacctccccctccctgtgtgcccaccagcttctgtgtcaagcggttaaaactgcctacctcctggtactgtagagactgctgtggtggggggcagccaccccatcaatgattatgtctggcagtgatatcaccacccacttcagaagccctcactgccccattgccaggattggcaataatagcccaggtgactgtgcatggagcacttacatgggtcacacactctgctgatcacttcaggagtgcatttcacttcatgctcaccacagccccaagcctatgaggtcttgtgggggccatttcacagattggaaactgagctgctttcataggtcaccccgttttctcagtggcagagacagcatttggattcagcttcaatgaactcccaccttgcccacccctttcttgaacttccccgcccccaactctctgtgttgcaggactttccactctgcattcaggcactggggagtctcccatgtgcagggcagggcaggagaatgggtgccagccaacaaggaaggagagtggtggggtagggtggatgaggaagggacttgtatccagcatcagctgcacagcagagggtctaactccaccccacataccccctcctgtgatgaggcccctcctctatccaccagcaacaccagcaggacccaggtgacatggcccagctttcaggggtggaggcacatccctgaggaaagggaggactcacgcctgcccacctgccccagacccagcacctaccgcagatgctgctgcttttgctcagggcacctgccagggcctctgtacctgccccatagagcccactgtcccaaaagttcagccacttgacatatggattggagctcaatgaggaagccagagaccggcgccctgggacagacagagcaaacacactggccactatcctggctcatgctccagggctcagcccgctccacgtcccccacctggaaagtacccccctttccacctgcttaagggacacatgcttctccttttaggccccacctaggtgtcccccacccccacctctcccagagcccccagcgggttagaagcctgaaggctccccaacccttcatgccatctgtcatagcatcaatcccatctgtctctcagatgtcgagggtagggcatgcctggcacaggcagaagctggggagtacaggggacagactcaggggcactcccatggctgttgtctcccggggcctctccctgtaagcctggacccagtgtccttccagtggtacctggggccccaggccaccgtgcagcaggttcagctctggggcactcccttggcacagaaagcagaagatgggcacaatgctatggatccagcaagacctcaggtacagggtgtccccgaccagttctccaagtccatgggtgcctggtaggagacagggggatgaatgtgaacccctgcatggctatagccacctgcctcctcccctgccctgcatcactacctggcctattttttgcctctagaagcactgcttcctatgctccttaggaccactgcccgcatatgacagataagaacatcgaggctaaggcaacgcaaatcttttccttaaagtcatacagctgtcaaaagaaagctggacaacctgggcaacatagcgagataaaaaattatttaaattagccagatgtggtagccccctgtagtctcagcgactcaggaggctgaggcaggaggctcaccagagtgcagagttcaaggatgcagtgagctatgatcctgccactgcactgaaagctgggtgacagagcaagaccctggctctaataaatgaatacataaagtctcacagctagtggtagctaatcctgccagagtcaggcctctacctgtctgatgacaaatggcacactatgtcttttaacctgattgcagaccacaaatgttttgtgaatattttccccagggaaaaaaccggaagtagttctaaattctatacatccattatattagttttacctgtggattgggaaaacccagctctgattgcatttcagggcgggacagcctttggtgcactgtctggcgggattttccattttaacctccttctagaagcgccttctcatggtaaagttcctgatgccgccaggagcgccgaggagagggcagggggctggagacgccccgcagagggctacgtgccctgctggacagaggtctcctgcctcctcggcggcgccagcccacctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgctgtaggttgccgtagaaaccgtggctctcctgcgctgaggctcctcgcctgagaggataaactgcacgcgccacgggctatgcactgggctgggcgccttgtgggcatcctccctgccttcctagggggttccagcatcgcccccctttcgtggactgggaaacacgcctgactccaggacttgtgttgtcctcactgcactggggaaggtggcgggggcagcttttcaggagggcctggggaacttcgcagagccaggtcaccctctcactctgtgcctcttagttatcttgcatgctctggtctttgcatacgctgctccctgcaccaggaacctccatccccatctttgtctgcttgtcgaacttcagaaatctgcaagggtcagcttagaggtcacttcttccggaagctttcctcaacaccctccccgccctgctgctgctgccctcaggccctcctctcacagcactgataacagctgtccgtctccaccctcccaccacctccactcccaccccaggaagtgaggccagagggcagggacagagctgctgctgttctctgtgtgccagggcccagcaaagggaatgtagggagggtgggaggtgcagggcagctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtaagagagaagagcttttggccaggctggaggggcaagggaagaggtggggggtggggcttggtcctgctgggttgaagttgagggttgggctgtttaggggctggagtggaagggggcagattgggacggggttggggagagctaggcgatacaagacaggagagcaagaacaagctgtgtgtttgtcctgtgtgtccacttgcctccttcccaggcccccacccaggccccacccagggggcacatgacatagtccttaacatctgtgagagctggagcactaggcccccagagagaccaccagctgtatctcgggtcaggagagtctgtaagggggaagctggatctagtcaggctgggggtgggtgctggctagtgaaggtgattgtctgagggcattggctctctgatgcatggctggagcttctgtctcattcagggggtctggagtgggaagtggggccagagaggaggtggggccttcgatgttgggccgggagcctgtagggtgtggggggagaactgagcatgtagggctcagctccgcccctgtcactacacgctggggacacaccacactgcccgacttctcctccccaggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgggggccctgatgttgctgacgggggcgcaagtcctttccccactgacagcctgaacacccgccatgcagccagtgtgtgcgagagagaagcatgtgatgccagagacggctgcgggttctcaggaagggcttcacagaggagtggcacctggacaggactttcagggatgtgtaggaggttttggggtggaaaaaggggccactcaagaagccaggccagggttggacgtgctggctcacgcctgtaatcccagcactttgggaggccaaggcaggtggatcacgagattgagagtatcctggctaacacggtgaaaccccatctctattaaaaatacaaaaaattagccgggcatggtggtgggcgcctgtagtcgcagctactcgggaggctggggcaggagaatggcatgaacccgggaggtggagcttgcagtgagccgagattgcaccactgcactccagcctgggtggcaaagcgagactctgtctcaaaaaaaaaaaaaaaaaagccaggccagagaaactgcatttccaaagactgccaacagaaaagaagggagtgtccaggactaatggcttgagcttgagagtggtgtgaggtgctggggcatggaacttccctgtagccctgctccctgacctggggcactacggtcaggtgctgctcctcccctcttctcggctgcgttttcctcctccctccacccagctcatccccagcctcaactgccacttctgctcctctgatgcccagggtgtattcccagtgatcacctgcccagagcacagctgtcttctaggtgcacacccacatgtccaaagatcaattattttcctctcctggcatggcctctgtgacgcccactagtcatggtggctgtgacatccactagtgcctcagccagacccgtgactcaccctggaccccttcctgtcccttccaagatttttcaccactacccatgccatgccatgcatgagactatggcctcctagagggtccctagatgcccctctcgcctcctcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcactggagggtcagcctttctttccaatgtcctcggccacccgttgaccacagacacagctttccctcttctcccttggcccctgccatgccagtgctgctgtgtgtgagatgggagactcacctcgtctccatcctgagcaggtgctgggcccagctctcccttggatcttcagtactagaagcagcaggctgttggaatattctggttggagccaggcatggtagctggagcctgtagtcccagctacttgggaggctgaggcaggaggacctcttgagtccaggagttagaggttgcagtgagcactgatcacaacactacactccagcctgggtgacgaagtgtaatcctgtctctaaatacacacatacacatgcacacacacacacaaattttggttgagacaagagacttgtctcaagagatggacatgggcacaaggcttcctggtctcaaaaatggccagaaccactgccagcctcccatctctgcttcagtctgccttacagggggacagggttaatgacttgatggggccaacatcccttccctcataaaccaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgagtttacccaggatcctcccagcgggtcccttgttcctccatcagccccagggggccacccgtgtttccctttccccttcccaggtggctgaaggctcagcctgtgctcggtgtcccccaggcactgggctacatcttttcctgaatcattatgttcagtcttcacatatcccctgcctggtaggaagtcctgtgatccccatttcagaggagaagactgaggctcagtgaggttgagtcactttcttaaggcctccaggcctgtgggtgacaggaccccgagctctgggcagcagcagttcccatgaggtgtccaggccctcccatcctggtcctgcctctgggtactctccaggttggtagtgtgacacccagagctgcgcacatgctcagggaggttctaatagcaagagccaagctggaatatcacctccccttgtctgtgcccagcctctattaatatgtcctgaggcagctttcatctttgtgggccaacacagcacactcttgctcatggtgaattcaggattgcttatgatttctggatagttttttttgttttatttttgagacggagtttcactctgtcacccacgctggagtgcagtggcagatatcagctcactgcaagctctgcctctcaggttcacgccattctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaaaaggcatactgattttaagccataaaaaggcttattggttttgagtcacaattaaagtaggtataacattgaagatttggacttttgaatctaaaagctttttttttttttttttttaagacagagttccgctctgttgcccaagctggagtgcagtggtgcagtcttggctcactgcaacctctgtttcgtggattcaagtgattctcctgcctcagcctcccgagtagctggtattacaggcatctgccaccatgcctggctaattttttgtatttttagtagagacggggtttcaccatgttggccaggctggtatcgaactcctgacctcatgatctgcctgcctcagcttcccaaagtgctgggattacaggcatgagccactgtgcccagcctaaaagtatttttattaaagcgtgctattggccaggtgtggtggctcacacctgtaatctcaaccttgtgggagactgaggtgggaggatcgcttgagcccaggaggttgagctgcagtgagctatgatcttgccactactgcactccagcctgggcaacacagtgagaccccatctgtaaaccgtccccccccacaaaaaagggtgctttcatcccaaacaaccgtcctattggtaactagagaaatatcaaattaaaaagaagacacaaagaaatataggccaggcacggtggctcatgcctgtaattccagcactttgggaggccaaggtgggtggatcatgagatcaagagatcgaagccatcctggccaaaatgttgaaaccccatctctactaaacatacaaaaattagccgggcgtggtggcgtgcgcttgtagtcccaactactcaggaggctgaggcaggagaatcacttgaacccaggaggctgagtttgcagtgagccgagatcatgccattgcactccagcctgggtgacagagccagactctatctcaaaaaaaaaaataaaataaaataaatatggttagctttagggacttcctttaatcttcctcaatattaaagaacagaaatcagatgtagaaaaaaagttgaaatctgcaccctctgtaaattatcctcctccacccacctgtgctctgctcaacccccaagtccctgtccctgatcccccagaaggtctttcggatatctgggcccctgacttacacttaccctcctcaaaacttggccctattctccttagcaaatttcttttagacctaaaacttctccaaatatcctttcaatgcccagctgcctactttaacttctcttttcctataaaattcacagaaagcaccccagcctgttttccaggcccaagatatacaggtgacatgtatatactgatagccagaaaatagacctaacacaggctctgggaatgagcagccaggcttgcttcactgtaccttacaattcctcctacttcctggggctctgtaatcaaatctcatcagctccaggcattcccatgtttaggccgaaaccacaaaaaagtctactggactatcgtactcttaggaaaaagaaaccataaaaattaccctagatctctgataacaaaaaatatgctctgaaactccttggagaaaatctacattctttctcagttttcttgctctgtcgccagtcttatcatatctttaaaacttaagggccaggcacagtggctcaagcctgtaatcccagcactttgggaggctgaggcaggcggatcacgaggtcaggagatcgagaccatcctggctaacacggtgaaaccccgtctctactaaaaatacaaaaaaattagccaggtgtggcggcgtgcgcctgtagtcccatctgctgggaaggctgagacagcagaatggcgtgaatccgggaggcggagcttgcagtgagccgagatcgcgccactgcactccaacctgggtgacagagcaagactctgtctcaaaaaaaacaaaaaacaaaaaacaaaaaacacaaacttaagtatctgaggaactgggctgggcacagtagctcacgcctgtaatcctagcactttgggaggtcaaggtgcgcagatcgcttgaggtcaggagtttgaaaccagcttggccaacatggtgaaaccctgtctctactaaaaatatatatatataaaaattatccatctgctggggaggctgagacagcagaatggcgtgaacccgggaggcggagcttgcagtgagccgagattgcaccactgcactccagcctgggtgacaggacaagacaccatctcaaaaaaaaaacaaaaacaaaaacaaaaaaaaacttaagtatctgaggaattggctgggtgcagtggctcatgcctgtaatcctagcactttgggaggtcaaggtgggcggatcgcttgaggtcaggagttcgaaaccagcctggccaacatgatgaaaccctgtctctatgaaaaatatatattaaaaaagttagccaggtgtggtggcatgcacctgtaatcccagctacttgggaggctgaggcaggagagaattactggaaccactcgggaggcggaggttgcagtgagctgagatcatgccattgcactccggcctgtacaacagagccaggctccatctcaaaaaaataaaataaaataaaataaaagaatctgaggaattaactagaacaacccccagtatgctagtctgagattaaaaaaagtgttgaatgtttaacattttaggtgctttacttcaataatgtttgatatttgcctaatatatatgtcataaaaattgccagcaaaataaaacttaagataataactagctttgtctaatgtttcatgaagttttcacaattcagatataattgttaaataaactaaacttatataaatgcaagtgggaaaaaatttgtaaataagttattattattattttttgagactgggtgttgctccattgcccaggctaaagtatagtagtgggactgtagctcactgcagccttgaactcctcttgccccagtatcctgagtagctggggcaatgcctggcaaatttttagaaaaattttcttgtagagtggagtcttgctatgttgcccaggctggtctcaaattctgggcctcaagcaacctcctgtcctggcctcccaaagtgctgggattacaggtgggagccactgtgcccagctataaataattttttactgttttaatttttatttttgactgactcattgctagccagagctcgggtttctgtcacccacagcctgggaggccttaagtaagtgattcaacctcactgagcctcactctttgcctctgaaatggggatcacaggaattcctgccaggcaggggatatgtgaagactgaacgaaatgattcacacaaagatgtagcccagtgcctgggggacactaagcacatgctgagccttcagccacctgggaaggataaagggaaacacgggtggccacctggggctgatggaggaatgaggggcccgctgggagtatcctgggcaaactcacctctgggcatctgccctgatcttgggctggcgtcacaaggaagttggtcaccaagaagaacacgttctctccctaggaggcaagtctcaaagttggcctggctgggcttgcattgactggaaaggccagaagccggcagcctggtttatgagggaagggatgttggccccatgaaatcattaaccctgtccccacgtaaggcagattgaagcagagatgggaggctggcagcagttctggccatttctgagaccatgaagcctcatgcccatgtccatctcttgagacaagtttctttctcatttgttcaaccaaaatatcttttattttctttcttctttatttttttttttgagacagagtctcactgtcacccagactggagtgcagtggcatgaactcggttcactgcaacctctgcctcctgggttcaaaggattctcctgcctcagcctcctgagtagctgggattacaggcgcacagagtttcactttactcgtccaggctggagtgcagtggtgtcatcaacccttactgcatcctgtaactcctgggctcaagagatcttcctgcctcagcctcccaagtagctgggactataggctgtaactaccatgcctggcgtcaaccagaatattacgacagcctgctgcttctagtactgaagatccaggggagagctgggccctgcacctgccaggatggagtggaggtgagtctcccatcccacacacagcagcactggcatggcagggcacaggtgagaagacagaaagctctgcctgtggtcaaagggtggccaaggatgttggaaggggaggctgaccctccagtgctgcccatgagaacactgaatttggggaatgcatgcccaggaacggaaggtgagggctgtgcagagggtgctgagagtggcagccattgggattaggagggatgggtggccactatcattggcggggggcctcctgagggtagaaacaggggctgcaggctctcatgatgcctggtgtgaaagttcagcttggctgctgtgtggtgtgcaccaagcagtagggaggaggcgagaggggcatctaagggccttctaggaggccatagtctcatgcaggcatggcatgggcagtagtgaaaaatgttggaagggacaggaaggggttgaggctgagtcatgggtctggctgaggcactagtggatgtcacagccatcatgactagtggatgtcacagaggccatgccaggagagggaaataattgatctttggacatatgagtgtgcacctggaagacagctgtgctctgggcaggtgttcactggggctacatacaccctgggaatcagaggagcagaggtgggtggaagttaaggctgtggataagctgggtggagggaagaggaaaatgcagctgagaagggtggaggaggagcacctgaccgaggtgccccaggtcagggagcagggctacaggaagttccacgccctggccccaccacacccctcccacaccactctcaagctcaagccattagtctcaaacactcccttcttttctgttggcagccttcggaaatgcagtttctctggcctggtttctcaacccatccctttttctaccagaaacctcctacacatccctgaaagtcctgttcaggtgccactcctctgtgaagcccttcctgagaacctgcagccacctttggcatcacatgcttctctctcgcacacactggctgcatggcgggtgttcaagctgtcagtggggaaaggacttgcgcccccgtcagcaacatcagggcccccacctgaggtggcttcacgaagtcggccacatcccacagccggtttccaagctccttgatctgagtcacggaaacccctttgagtttggttgtgatggaaatctggggttccaggtcccgctcctggtagccttttttggcgaggagcgcccacctgggaaggagaagatgggcagtgtggtgtccccccagcgtgtagtgacggggcagagctgggccctacatgctcagttctctccccacaccctacaggctcccagtccagcatcctctctggccccacttcccactgtagactccctgaacgagacagaagctccagccatgcatcagagagccagtgccctcagacaatcaccttcactagccagcacccacccccagcctcagtagacccagctccgagcttatagactcccctgaccggagatatagctggtggtctctctgggggcctagtgctccagctctcacagatgttaaggacaatgtcttgtgccccctgggtggggccgtggggagggactgggaagcaggcaggtggacacacaggacaaacacacagcttgttcttgctctcctgtcttgtattgcctacctcccaccccgtcccattatggccccttcccctccagcccctaaacagcccaaccctcaacttcaacccagcaggaccaagccccacccccgacctcttcccttgcccctccagcctggccaaaagctcttctctcttaccctaccacatagacgacgatcccaaactgcagcagcctctgcagggcgcccccccaccagttcctggtcatcacatacttctccgttttataatccagaagcccctagtctgctgtggcccctggggagcccatgctgccagctcctgctagctgcgggcacatgagtcagcatggcagctgcagccgcagctgaacaggaggcaaagcagggcccgagccaggccacgccagccgctgttaaagggacacttccactaaagcaggatccagcctccaacacccagccttcagcccctaaccccagctgccctgcacctcccaccctccctacattctctttgctgggccctggtggcacacagaaaacagcagctctgtccctgccctctggcctcacttcctccggtgggagtggacgtggtgagaggatggggaaggacagctgttatcagtgctgtgagaagacggcctgagggcagcaacagccccgggggggctctgagtaaagcttcaggaataagtgacttctgagctgacgcttgcagattctgaagttcaacaagcagacaaagatggggatggaggttcccaggggagcgaacagcgtatgcaaaggccagcgcatgcaagagaactgagagccacagagtgagagggtgacctggctctgcgaagttccccaggccctcctgaaaagccattcccaagtgcagtgaagaaaacacaagctctggagtcaggcatgtttcccattccatgaaaggggggcgatgctggaaccgcctaggggaggcagggggataaacgcagcaaggcgcccaatccggtgcatggtctgtggcgcatgcagtgtatcagcccgggcgaggagcctcagcacaagccggccacagtttctacggcaaccgacaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggtgctcgggggagggggcaggcccgactcctcccctttgggggtcttctcccgcaggggttgggggaggcgggctggggctaaggccagcagggaacgtacccgcctgcggggcgcctccagccccctgccttcccttcattgctcctggaagcatcaggataaaatgcaaaatcccgccagacagtgcaccaagggctgtcccaccctgaaatgaaatcagagccgggttttcccaatccacaggaaaaactaagctaatggatgtatggaatttagaactatctcggttttttctcccgtaaaatgtttacaaaacatttgtggcctgcaatccaggttaaaagacacagcatgcaatttggcatcagacaggcagaggcctgactctggcaggattagctaccaccactagctgtgggatgctcagcgcaggccagccatgacttctactacaaacaacattgggttgcttgggctcatatttattaataaataaatatataaataaattatttatttattagagccagggtcttgctctgtcacccgggcgtcagtgcagtggcaggataatagctcactgcagccttgaactctgcactctagtgagccttctgcctcagcctcctgagtagctgggactacaggagaccaccacgtctggctaatataaaaattttttggctgggtggggtggctcacgcctgtaatcacagcactttgggaggcccaggcaggcagatcacctgaggtcaggagttcgagaccagcctggccaacatggtgaaaccccgtctctactgaaaatacaaaaaactagcccagtgtggtggtgggcgcctgtaatcccagctactcgggaggctgaggcaggagaattgcttgaacctgggaggcagaggtttcagtgagccgagatcgtgccactgcattccagcctgggtgacagagcaagagtctgtctcgaaaaaaaaaaaaagaaaatttgtctagctatgttgcccaggttgtccagctttcttttgatagccgtatgactttaaggaaaagatttgcgttgcctgaggcttgatgtcctcatctgtcatatgggagcagtggtcccaagaagcacaggaagcagtgcttctagaggcaaaacataggccaggtagtgacacagggcaggggaggacacaggtggctgtagctgtgcagggtccacattcgtccccctgtctcctgccaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccaggtaccactggagggacactgtatccaggcttacggggagaggcctcgggagacagcagccatgggagtgcccctgtgtctgtcccctacactccccagcttctgcctgtgtcagtcatgccctaccctccacatctgggagacagatgggattgaggctgtgacaggtggcgttaagggttgtggatcctgcaggctcctaacccgctggggggtcagggagagctgggggtggggggagaccttcacagagcctaaaaggagaagcaggtgtcacttaaaacaggtgggaaggggagggctttccagctggaggatgtggagtgggctgagccctggagcatgagccaggatagtggccagtgtgtttgctctgtctgtcccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggtaacgcctgcgcagggcaccatggccatgaaagctcagcttcctggggcagggatgggtgggggttggcaggaccgcgctgcacatcgccagggagcatgtgctctggttcctgctccccacaccccaccttgccccactcctcttccactccagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagtaattattggtgctacaaaagaaacaaatagtttatgattctagagaagaacagggaccccctactttaaagaggtggctggggaggcctctgtgaggtgacatttaagctgaaatgtgcagggtgggaaggagtcagccatggcaagatcagagggagagcattgcaagcagaggaatagtgagcatgcgggcctgtttcccagactggcggacagcagtgtgcctaggctagggagccagggaagcgtggccaggctgtggggtggagagggcagagggggctgcagggctgtaggccgtggcaaaaacggtgaagattttgtttcaagtgaggtagcggatgtgattgggattccttgatctcatcactgtcatgcccctgagcatattcaggagctgtctgctttgccaggaatttgcacttctacctgcctctcctcaaatggtccaataatggtaaggatcacctgagaccctgggttaggcatgcagatgctgaccctggacctgctgaaccaaactcttaggggaatgctggtgaatctgtattttaatggttgccccaggagaatcgtctttttattttttattttttgagacagagtctcgctctgtcacccaggctggagtgcaatggtgtgatctctgctcactgcagcctctgcctcccaggtccaagcaattctcctgcctcagcctcctgagtagctgggattacaggtgcgtgcgacaaggcctggctaatttttctatttttagtagagatggggtttcaccgtgttggtcaggctggtctcgaactcctgaccttgtgatccgcccgccttggcctcccaaagtgctgcgattacaggtgtgggccaccgcgcctggccgagaattgtttttcagaagcactcctctgtctccagctgcttagagcaagtggggtgacatcagccttggcctgtgagaattgcctctggcatataactgccagagaaccagtttgccttctaagaaaattattgcaagaagtcagtgaaattaagtgaggtggccgggcccggtggctcacgcctgtaatcccagcactttgggaggccaaggcaggtggatcatgaggtcaggagatcgagaccatcctggataacacggtgaaatgccgtctctactaaaaatacaaaaaattagccgagtgtggtggcaggcgcctgtagtcccagctacatgggaggctgaggcaggagaatggcatgaacccaggaggcggagcttgcagtgagccgagatagcaccactgcagtccggcctgggcgaaagagcgagactctgtctcaaaaaaaaaaaaaaaaaaaaaaaagtgagacttggcaaggcactgtgcctatctgtaatgccaacaccacttcgggaggctgaggggcgaagattgcttgaggccaggagttagaaaccaaactgggcaacatagggagccccagtggtgacaacaaatgattaaaaaaattagccccgggcaacagagcgagactccgtctcaaaaaaaaaaaaaaaaaaaaaaaaaattagccccaagtggtgacatgtgcctgtagtctcagtcaggaggctgaggtgggagaattgcttgagcccaagatgtcaaggctgcagtgagccgtgattgtcccactgcactccgggttgggcaacagggtgagaccgtgtcttaacaacaacaaaaaatactttctttcctctttagtgcctgtttccctgttatgatgttaaaagcaggtactgtgatgtgcagctggtttctggctcttctgcaggcgctttcttgtgtgtataaatgttcgctttggtgttcctgtgagggttgtaggatgaccgctggagggttctgttcggccatgttgctccgccttcatctctaggtctcgctattttgcccaggctggtcttgaactcctggcgccaagaaatccttctgcctcagcctcctgagtcgctgggaccacaggctcacaccactgcctggctttcaccttcctttctctaccacccccatctcctctctaccacagctgtgccagccctgttgcctcttgcctagcctatggcaccagccttccatctggtcccccagcctcttgcctctgcccccacccagcccagtctatcctggacacctgccacttgctgaaatgctaatccagcctcatcacttcctaaggccctccctgactccttgccacttgtatgtgctgcctaagccccttggcttggcacacaaggcccctcagcatctctcaagtgcccattactccttcctcacctcactggcttccccctccccaggcccagctccaagcctgcgtgcatttccacaggtgcctctgccatttgcagtttcctgtgtctcctccccactgtgcataagcctgtgtgcatttccacaggtgcccctgccatttgcagtttcctgtgtctcctccccactgtgcatgcacacacccctggggaattcctcagtcctgagttatctcctctgtcctctttcctgacttcccccaagacaggctggccaccactctgttctcacgcctcccccttttagtctaaatgaatagctcacatcccatacatttgcatttgtatctcccccatgaaatgtgagttccttaagggcaccgcaggcccacattagtttcatgtctgtgaccctcctgcccagcagaggctcggcacgcagtgggcatcagtgtgatcttttgaaggagtgaagagagtgagtcagaaggtctctcttggtgtttctgaaggggagacacttggaccagccctggcagaaaacacaggactcaccgagcttaacgtgagctggaatcacctccggggcccaggagctgtggcatttgccaggggactggaggtatgaagcccccacctagtcggccctacagcctgtctgctggggcctgtctcccaggggccacctccctgtctctgcagctcctcggaaatgaaccttggatcttttaagcacagcttaaagactgtttctttaggtgattttaattttcctggcttcacttagtgaccacaatacactgtgctcaccgtcacatactttcctgaagggtcactgttgaatatcttgcaccttccccagacaccatagacacccagctgggaagggacatctgtgcagtctggtgacacatgctcactgttgggcatacgcaggtggtttcctgagatgacaccttgcacccttggatgccagcacagcctctcaaacacccacctgttcccttccatgttgtggttcatagggctcgggaatgggtggctcaagctggtgctagggtggtacaaggtgtctgcaatgtccccagtgccagataccctgtggggccctcctcaggccatggcagctgctgtcttgccctgatgcaggggctgaccttggggtcctgccccacaagatggcatgtcacactctgtcttgccagagcacctacccttctccccatcacagtacgctggacaggtttcatccaacagctgttcactggatcttgggatccctgccctctagagccattaagtgggtgtggagtccgatcaatgtttctggggcctgctgctgctctgcacacgcccctcccagtctctctgagggccattcacgtctacaccggtcctttcctgttgtgctctgggccactgggctctgttgaccaccatcatccaagctgcagccaccagggggtctgcatggcactttcctgacccttccttggagcctctccccttctgccctttatctcttatctttgcacctcagggctcctggtctctgaggctgtggcaccctggcttgctccactgtcagatggggtcccatgacttcactctttggtattctaggcaaacatcttccttaaagttctagacatctcatacaatggctttggggatcctggagcctctgcggtgggtgaggctctgaaggccaacaacgtgttggaggaactcaacatgaggtgaggatccccggggggacaccccaggaatcatgggctccatgatcttgctgctgaagcacacagtctacccgtgatggggattcccgtgatggggcttgagccacaatcccagagcagctctgtcatccttatcactggagtttataattttatttatttatttaaaacagcatcttgctttattgcccagggtagagtgcagtgctgtgatcatggcccactgcagccttggccttcccagctcaagcaatcccaccacctcagcctcccaagtagctgggactacaggagtatgtcaccaagcctggctaattttttcttttttgtagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatggtgggtgctccatgcaagctttcctcccttgcagaagacgagccagggccaggttctgtggctcacaactgtaatcttagcacctaggaaggctgaggcgggaggatccattaaggacaggattttgagaccaggctaggcaatatagcatgactccatctctatgcgaaatctaaaaattgtccatttccggtggcatacacctatcattcctggtacttgggaggctgaggcaggaagattgcttgagccgaggattcaggatttcaggctgcattgcaacagagcgagtaaaacgagcctagtctgggtggggcaaggcaggaccctgacaagtgggccccagtgcctgttttgctcagcatgtggctactggagcatgccctgtgtgaggggctcctccaggccaggcagcgtcccagcctagccaggaggcacaagcccagagggaagaaaagaggcggatgccagggaggtcacgggccagaggccagggaggtcatgggctgctgtggctgagaccctccccaggggcagctccctgtgggcaagaaggccccactcaatcctgcccagctttcctccccatgggaggagctaagactggaggcagccgcggaggctgaatacggaggtgcagccagagctggggtctgagaagtcagagagaagcgggactgactccggagacaaagtggtccagggcggtgctgaggactggagtttgggaacggcaggaggaggagaggccttgaacataagctaggtgattttctggaacaggcgttgtaatggtgataggcatgaggtgtcagctggggcagaatatgtgggagcacttgcagagctcagaggagcggcagctggtgtccaccaggacagggacgctttaggtgtgtttgccgtgtgattcctctgaacggtgtcatctccaccttttacctgttgatctgtccagggttcctggggtgtgagtggagggaacaagagacccaacctggtggctgcaatggcagctccagtgggcaccctggggcagtgggctctgcaccgctgcttggaaggttgcacaatgcatgtgcctgttgtttttgttgcagtaacaaccgcatctctgcgatgggagccctgagcctgggcctgggcctccgggtcaaccagacgctgaggattcttgtagtgagtgctagcctgatgactgagacaccagcacagacctgccctgtaacagtccacacagatccctcccccacagcccccacccaggggcagcaggcaggtgcacacaggctggctcactcccttgccactcaccctgaatctggggcctggccctcctcttctccccttcatccctcccagcctctctcccacatcttcttgctgcccttcctcctctgtgggctggggtgctgctctgctgaaggtggctgggcaccccttgtgtctccctcatcttctcccctgcctttcctctggccttgctgagacccaggccccacccaggtgttctgttggccactgctcaggcccacctgaggcctggtgttcccagctggggttccttcccctgggtttgcaggtggggagggagtgctgagcaggacagggagcagaagacagacacaggagggaggcaagccgggagcaggtccccaggggaccactgtgcccacagcaggtacgtgctgggggacagtattgccagctgggtatggacatccagctctgtcggccctcagctccccaccctagccttactgggcttctcccatagctctcctcccctgcttcctgcctcacaggaacctggacctctctgaagcatagacctgcgtttcgagtcacctcgtagacagtcctctaaatgtcccaaagacacgtgggaatgtgagagtccaacctgaacgcatacccccctctaagggccacctcctggtggggggctccttcttccttcttcccaagtcaccagctggggcccagagcctgcctgcccctcccttttccacaccctccctcccaccttctgcaggggctcaccctgctgactcctccctcttctgacttcctctcttagcttctgtgaacttgcgggattcctggctgcggttctttcttcccagctgctacccaggaccagaaacatgccctgctttaaaactgttggagttttatcccctctggataaacccaagctttgagtgcatcatgtcatgcggagctaggtgtggtggctcacgccaataatcccagcacttcgggaggctgaggcaggcagatcgcttgaggtcaggagtttgagcccagactgaccaacatggtgaaaccctgtctctactgaaaacaaaaagatgagccagatgtggtgatgcacacctataatcccagctactctggaggctgaggcaggaggatcctttgaacccaggaggtgaaggttgcagtgagctgagatctcaccactgcactccagtctggatgacagagcaagactctgtctcaaaaaaaaaaaaaaagtaacatagcatgtcatgggggatctgggctctgccagcccctctcttccaagttcagtgctctcaccccaagcttggagcacacacacacacacacacacacacacacacacacacacacacacggtactatttttcacccctgcctttgttcctctgctgttcttgctgaagtgtccagctccggccacctcacctgggaagctccgctgagccctgcccagatacacctcccctcccagcctttccctcccaggggagctggtgcacactcactcactgcgctgatcacaccacatttcatgatgcttcctttccctcccctctccccagcaggcaagttcttaaaggcaagggtgtgtcttgtgtgtctatatcaatcggaggcctctcccttcctttcttccctgacccagcagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagtaagagcattttataaacctcgtttctgatcctcccagcagccctgtgaggtatcataattttagaagaagaaagtgagggttacagaaatcaagagccctgcccagttacacagcgtggcagaagcagagttgcaacgggacttgaatgcaggcatggggccactcagctctgcccgctccagactgctggttccacgggatctcacctggggcacctgcctgggttcttcattggctgagagaggataagtggaggtctgggcatgatgctccctatccactgaggtttcgatctgcaggcgcagcacctgcaaggctgccctctgcccctcccctgactgtctgcaggtggactgtggtgctggaagcttcacttgagtggctgtgagagagattaggatcccttttcattcaattttgccactttttttttgagtcagggtctcactctgtcacccagttgcagtgcagtggtgtgatcgtagctcactgcagtctcaaattccttggctcaagtggttctcctgtctaagctccccaagcagctggaagtacaggtacaggtcaccatacctggctaaagtttttagagatgggggcttgctatgttgcccaggctggttgcaaacttctgacctcaagtgatcctgtgccatggtctctcatgtcttgggtcaattttgattttttttttttttttgagacagagtctcactctgtcgcccaggctggagtgcagtggtgctatattggctctctgcaacttccggctcccagattcaggcaattcttctacctcagcctcctgagtagccaggattacagatgtgtgccaccacgcccggctgattttttttttttttttggtattttttttagtagagatggggtttcaccaggttggccaggctggtctcgaactcctgacctcaggtgatccacccacctcggccttccaagtgctgggattacaggcatgatccattgcgcctggcgaattttgatttttttaatgtagaaaaagtgccaggtgagatggctcacacctataatcttagcatgttgggaggctgaggtgggaggatcccttgaagcctagagttcaagaccatcctgggcaacacagaaaggtccccatctctacaaaaagctttttaaaaaattagccaggcatgtggcacatacccgtagtttcgggtactcagaagactgaagcaggaggatcacctgatcccaggagtttgtggcttcagtgagctatgattgtgccactgcactccaacctggggaacagggccagattctgtctcaaaaaaaaagggaaggaaacaaaaaaaattgagttacaaatcagtgctgattctaaccctgatttttttcaacccagacttgagtcaaagcctttccagaaatgtgtctgtgtagtttcaattcttcaggtttgggacaaccgatgtcaaacgtccttaccatttccttctaatggcctgttcttgccttaaccatgtgcctgctgctctgagaattcctgtcagcactggatctgtcattctaaaagaaatagaatgtcatatggcattatcctgcctgaatatacacttacttgtcacaatgtatggtcattatcagaagcccctagtcttgtgggaatgccatgggctttggaatcagttcagggttgggaccaaatcctgtgtctatcaatgtgagatcctggacaagattctgagtcaaagaatcataaacgatcaatcaataacaagcctgggatgggcatgatggttcacgcctataaccccaggacctcgggaggccaaggcaggtggatcacctgaggtcaggagttcgagaccaccctggccaacatggcaaaacctgtctttactaataatacaaaaatttggccggagttggtagctcatgcctgtaatcccagaactttgggaggccgaggcaggcagatcacctgaggtcaggagttcgagatcagtctggccaacatggtgaaaccctgtctctactaaaaatacaaaaattagccgggcatagtggtatgcacttgtaatcccagctactcaggaggctgaggcaggagaatcacctccaggagaacccagaggcagaggttgcagtgagccgagatcgtgccattgcactccagcctgagcaacaagagtgaaactctgtgttgtaaaagatagaagaaaaattagctggatgtggtggtgctcacctgtaacctcagctactcgggaggctgaggcaggagaatcgcttgaaccagaaagcggaggtttcagtgagccgagaccatgccaatgcattccagcctgggtgacagagcgagactctacctcaaaaaaacccaaaaaacaaaaaaacaaagaaaaacaattagcctgaattgaatattctatcttctattccttaactgttgttatctgttatcactagtataatctgactagcccagattttattctgagctttgagggaaatagttttgaagacttatagttcaaggaaaatctttccctaggctcagacttgtgtttttgtgaaatggggctaacgtctaccccgcaaggccatcatgaacataagctgagatgacagacctaagggaaaggccttgcacagagaaggactccatcagtgccagttctgttcttcacaaccccttggttttttgtttttaattgaggaacaacatctatgctgaaaaatgcacaaagattaagcatagagcttggagaattttcacaaacagcataggtgtctatgtaaccagcccccagatctggaaatacagcatagccgggcatggtggtgggcacctgtagtccctgctattctggaggcttaagcaagaggatagatagcttgagtccaggagctcagggatgaagtgagctatgattgagccactgcactccagcctggtgacacagtacgatcccatttctaaataaataaatacagcaggcctctaaacatcccccattgtccccttctctcctggatcttactagtttgcgggtatgagactgtcatccacaggggagaagctgcccgaaggagcttctctgagaccttgcgtgtgtgagtgaaaaatggtgaagttctcagatagtaacaaagttcatccttgtaatgggtgtctccttaggatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtgaggagctctttgactcacgaggccttgttaccacttgtgtctgcactgagtcctcacgtcagccgtgtgctaagtccacacggtgctcacacacctgtaccctcctctgtgccccacggaccctgcactcatctgggccttcatgtgctctcactcattcctgtcacacaaacccctactaagtactgcacattgaactgggcatggtatccaagatgcccaagcaagtccctgccctccccatgttcatgttctggtgacctcaggaaactattaaaatgtaaggaggggtgcacactctacttttgagaatgcaaacgggcacagcctttttggaaggcagtttatcatcatgcactgagagcctcaaaactgcctgtgccctttgatacaatcatttgactaatgtgctctagagaaataaccagagatgtataaaagattgatgcctaaagatgctcatggggccggacgcggtggctcacacttgtaatcccagcccttttggaggcctaggtgggtggatcccttgaggtcaggagtttgagaccagcttgacaaacatggtgaaaccccagctgtactaaaaatacaaaattagccaggcatgatggcgcacacctgtaatccccgctactcaggaggctgaggcaggagaattgcttgaatcctggaggtggaggctgcagttctcaccattgcactctagcctgggcaacaagagcaaaactctgtctcaaaaaaaaaaaagatgcccatggaaatgctgtttatcataatgaaaattggaagtgtccccaataacgggattggccaattaaaatttggatatgttaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcagtcaatcacatggcttgtctgacagttcctcaaaagcttaatcatagaattaccgtataacccattatttccattcctaggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacatggtgaaaccccgtctctaccaaaaatacaaaaattagccgggtgtggtggtgggcggctataatcccagccactcgggaggctgaggcaagagagttacttgaacacagaaggtggaggttgcagtgagccaagctcacttcactgcactccagtctgggtgacagagcaagactcggtctcaaaaaaaaaaaaaaaaaaaaaaaggaagaatcaggctcagcgcactggcacatgcttataatcccagaaatttgggaggccaagatgggaggatcacttgaagccaggagttccagaccagcctgggcagcatcgtgagacccccgtttctacaaaaaacatttaaaaattagctgggcatggtggcatgtgcctgtcgttccagctacctgggatgctgaggtgggaggatcactcaaacctgggagtttgaagctgcagtgagccatgattgcaccactgcactccagtctggttgagagagtgggaacctgtctcgaaaaaaaaaaaaaaagaatggaaggatcaaactgggcatggtgatgcatgcttgcctgtaggcccagcctacaagggacgctgaggcaggaggatcatttgagcctgggaatttgagcccagcttgagcaacatagtgaaatcctgtctaaaaaagaaaaaaaggaagaatcaaataattgttccaaagtctttcaaaaggagtattgagtcccaactcggcactttcctgagcagggatatgtctcctctccttctcactaaggagccagaaactcaccccttctcactaaaaaagtgagaaaaataaaaatagctcagagaactttgagctatgtgaggcacgcagaatttatcaggtccggagacatgaatatgggacttcaggcagggcatgatggctcacgcctgtagactcaggaggccaaggtgagcccaaggtgggaggatcactttagtccaggagttttgagaccagcctgggcaacatcaggagatccttgtctcctcaaaaacttaaaaaaaaaaaaagctgggcatggtggcacacacctgtggtcctgagtcaggaggttgaggctgcagtgagctatgaccataccagtgcattccagcctgggtacacagcgagaccctgtctcaaaataataataacaataatatgctgggtgcagaggctcattcctgtaatcccagctctttgggaggctgaagtgggtgaatcacttgaggtcaggagttcgagactagcctggccaacatggtaaaaccctatcttttctaaaaatacaaaaattagccaggtatggtggtgcatgcctgtaatcccagctacttgggaggctgaggcaggagaatcgctggagcccgagaggtggaggttgcagtgagccgagatcatgccactgcactccagcctggatgacagagcaagactctgtctcaaaacaaaacaaaacaaaacaaaaaaataataattataataatgaaaagaaaaagaaatgaatatgggacttcagtaacatatttcttatccatgcccgggggcaattgtttaaaggcattttgttcctgactagcttaacccattatcttcctgtttctggaatttatgatacaaagaataatgtatagacaaccaatagcttatgtcgttttaatataaattcttgtggccagggaagctgaagtgataggattgtttgaggccaagagttgaagaccagcctcagtgagacccatctcaattttttaaaaaagagcaattcttggtaaaccacttaggaactgcctcttcttttctcttaaaaacagcatctctggccaggtgcaggggttcacacctgtaatcccagcactttgggaggctgaagcaggcaggtcgcctgagcccaggggtttgagaccaaccctgagaacatggtgaaaccctgtatctacaaaaaatacaaaaaattagctgggcaaggtggcacatgcctgtagtcccagctattcgggaggctgaggtgggaggatcacctgagcctgaggaggttcaaggctgcagtgagccatgatctcaccactgcactccagcctgggcaacagaatgagacgttgtctcaaaaaataaaataggctgggcacgacggctcacgcctgtaatcccaacactttgggaggccgaggcggtggatcacgaggtcaggagctcgagaccagcctgaccaacatggtgaaatgccgtctctactaaaaatataaaaattagccaggcatggtggcacgtgcctttcccagctactcaggagcctgaggcaggagaatcgcttgaacctgggaggcggaggttgcagtcagtcgagatcctgccactgcactccagcctgagctacagagcgagactccgtctcaaaaaaaaaaaacaaaaataaaaaaacaaaagaaaaacaaaatgaaaaacaaaataaataaaataaaataaaataaaaacagcattttgtaactgctgctaattaagagtgtatattcaaagcaacttgaatctccgctccagggctgaaggtcttaaatgtggcaataataaactttttttttttttaagagctctgtcactcaggctggaatgcagtggcacaatcacagctcactgtagctttgaactcctgggctccagcaatcctcccaccttggctttccaaaggaaaagggattacaggtgtcagccacctcactcagccttctcccttctatttaccttctcccttctattttagtttgttattctccccttttaagagcttcttccttataggtttaaccctgataggcagacacactttgttctcattctctttttttttttctgtcaccacagaatattttgcatgccatagagtttcaaactgtcttgaaatgaacgggttcacatttatgttctggttcacagagtgagtatctctatccacgtggggcaggcaggtgtccagataggcaacgcccgctgggaactgtactgccttgaacttgcaattcagcctgacggtcaaatgccaagtgacaaaaccatcggtggtggggatgactccttcaacatgttcttcagtgagattggggctggcaagcacgtgcccagagcagtgtttgtggacctggagcccactgtggttgataggtcctcgggcactggatggcagctttcctgggagagtgggagagcattggtaaaaccccacgtgcgctcctgtgaatccccctgcagaatggatgggatagacaagcaaatgcccatggcattgttagggcggaaactgaaagtttcatgtttagtgtatgtgagactcagctcctaatttaggatgtatgggaaaagctgctttgccagcagtaagatgggctgtggagagattcccctgtggctgcctcagccctgcacaggtggccctgcctgcagggtgtggggcattgattccctcctgaatgctgtgcactgtctcatgctggtgcatgaagagtcttgatgtgcatcttaggcgtagaaggtaagtacagaacatccatttccttcatccagattagaagtcccagatagtttccaaagagagctgcaaagagatagtacctttcagtgtcccccaggaggtgacaatgtcacctgaaagcacgtgggacccaggccacacaggttgatgggactgcccttcagaagtcacactgacctggtgactgtccagtttgtaagagatttttaacttacagcctttgatgtagtagctaagggtaggaaagatgtatgtacctgtagaattaccagtgctgggggacgatgcgagagcttatttcccttcactgggaactgtttatgctgacatttatttatgtatttatttatttatttatttatttatttatttatttatttagagaaagattcttgctctgttgcccaggctggagtgcagtggcacgatctcggctcactgcaacctccgcctcctgggttcacgccgtcctcctgcctcagcctcccaagtagctgggactacaggcgcccgccaccacgtccagctaattttgtttttgtatttttagtagagatgggttttcaccgtgttagccaggatggtctcgatctcctgacgtcatgatccgcccgccttggcctcccaaagtgctgggattacaggcgtgagccaccgcgcccggcctgtgctgacatttatacaagaactgactttaacttcctagggccttaaattgcatttgtgattggttatcacagagacattttctaccagacaccgccactgttgacctacaacatgtagctcatgtactttgaacagcatgtactttgtagaagtgaacagtcctggaacgtgttcaccttggtgtacagtaggccttaaagactcacagcacatgtggtctctttgtaggtgaagtgcacacagggacctacaggcagctcttccacccagagcagctgatcagtgggaaggaagatgcagccaataattactccagaggccattataccatcggcaaggagaccttgtcctggaccggatccacaaactggtaagaagagaaggcttcatgtggacgttgtcctgcacaggagaataggccttggatggtgaaaggaaggtcattttcgcagcacttagagcagcatcttgagtccgactaagtctgcaacgtcttactatgaagtatgcgtggtgatttgtgcatagatctgtattgtctgcttttctctgcttcaaagtgtgatgcgtgttcattatggatagtctgaatccgtagcaactctcagaggcaaagagaagtggccccggcttggtggaggttggtggtgtggctcccacgggcattggctcacattgtctggtttctctcaggctgatctgtgcatgggactgcagggcttccccatcttccacagctttgggggcggcaccgtctctgggttcatgtctctgctcatggagcggctctcggtggactacgggaagaagtccaagctggagtttgccatttgcccagccccccatgtctccatggctgtgatggagccctgcaactccatcctgaccacctacacgaccctggaacattctgactgtgccttcatggtcgacatgtcagtgcaacctggacatcgagtgtcccatgtacaccaacctcagtcgtctgattgggcagatcgtgtcctccatcacggcctccctgtgattcgttggggccctgaatgtgtacttgacagaattccaaaccaacctggtgccgtacacccacatccacctccccctggccacctatgccttgatcatctcagccgagaaggcctaccacgagcagctgtccgtggccgagatcgccagtgcccacttcgagccagccaatcagatggtcaagtgtgaccctcaccatggcaagtacatagcctgctgcatgttgtaccgaggggatgtggtcccgaaagatgtcagtggggccatcgccaccatcaagagcaagcgcaccatctagtttgcaggttggtgcccgactggattgaagggaggactgggtgatgtggagtccttgtgccatcaggaagcagcagatctgcagaataatgctgcccccaaaggcccgcatcctttgcggttgcttgtctggaaccgtcaccctgcccctgttccatgggctaggctcatgggcataaatcaatgaaccagagtgataattaattcagtggtgtcttttgaacttcctttgtgagtcatcacactatgtatctgtggtgaggtttttgtgtttttttaagaaaaaggtattttttggaggattttggtgccccttgcttggacagcagaatttgtgtggaaaagataggttgaacttagtagaaattttatgggcattttggggaatcatgtgggtggtgtatatattttaacttgggcattattataaactgctctcactaagtcttgcttcatctaagtatgtccaggttgtgccgacatgtgtcataggtggcttcgttatcacccatgaaggcacagtcagaatgttcatctgtagaaattatacccaatttaaatgtcttttggagtgtttgatttaaagaaagactatcaagaatctttttgtgacgaaaacagcaccatctttatttctcttttgggaagcctagtaatgttggcctgtgtttgcctcagacagaaaatctgtccccaccttccactgacacatgaaagaaaccttgctgtcccctttcagcttttccaggagttggtgactaaatcctgtcgcttctccctctgctggacctctgcgtcctctgctttgctttccctccctcctctggctcagacatccactgcctctggggagaccactgcagtcagctctaagtgggaattcctactctgggcttctccttctctccttcaggggtgagcatggctgctggactagccgcccaattttgtaaataaggttttgtctgaacacagccaccacaccccttcatcgcagatcaattttgctgtccagcctcagagtggggtaggtgtgacagagtccatgtgcctgtaaggcctagaatttgtatgatcttgtcacttatagaacaggcttgctgacccctgctctagttgaccccatgcactactcaggatgtgttattctcaagttctgaaacttggaatgcttcccttttggttcccaccttggaatgtcacttcctactcaagcaagcacatggactactcttgctgctgtggtagctccattcaagtgatctttgacctgtcacctttgcatatttcacagtggcttgtttggtgggacagcagggggtatgaccttccccgtggtatcacagttgtgtactcacaatctatctgggtggaaaaagttgagctacagaatttcattactatcttgtaaaaccctttggagtaaataatctataaagaagacaagtagtgtacattttcagagggaagacagtctttacctgggcacctatcacatgtcacagttgctaggacacagcccttcgggcagcttgggatcctgccagggtggccacctccaaggctcttttctctttattccttggctggaaccgtcaccctgcctggcacagagaagggcttagtgaggtttgtgggggtgaactgagcattctcctcgtcacctacagggggtcttctgtttgaggaaaggtagccaccatttctaggtttgatacaagcttcacggaccgctttcttgcccttctctggcaggtgggcattaactaccagcccctgacggtggtccctgggggaaacctgaccaagttgcaatgggccatgtggatgctaagcaacatcacagccatcaccaaggcctgggcctgcctggaccataagtttgatctcatgtatgccaagcaggcctttgtgcaatggtacatgggggaaggcatggaggagggggagtcctctgaggctcgcaaggacctggcagctctggagaaggattatgaagaggtgggcatggattctgtggaagcggaggctgaagaaggcaaagaatactgaggggagggtgtggtgggctctcctgccgcccccagcatggctgctttcaggttgtttgcaattaaagtttctctataaaaccaagacctctgtgtgtcatgctgcttggctctgcctacaggagcaggtgggaccccagagcctgcatggacagtcagtggggtcccagcctgccctgctggcatgcggttggggtgcagcaggagtgtatgtacttaaggagctgccatggaagtgacttgacccaggagaaacaagccaagcgttgagtggataggtttcctaaattctaggaaagctaagtcagggtttcaactgaatttgcaatttttggggcttttctattgatgggatgtactggctaaaaagaagagcctagaagcagagtgtttaaatctgaggtctatgaatggggcgtgtccatgaaatccctaaagctgtaggtcaaatgtgtaaggtcaggacattttagaagggggaaagtgttactgagttctccacagtatttgtgacccacagaaggtcacaacacacccatcctgaccccccactgctccatggtaacctggaaggcagcatttaccctccacgcacacacacggtcaccttgcccctcagcattgtcaactgtcttggtagaaaaccttgcacctttcacttcaagtgaagtgtgttaacatctgtttgtaaaagacctgggaatccagatatcttttctcagaaccaaagtcagctccaggaagttgactcaaggtgaagtgacctggttagttcagctgtggcacaaccaggacctgcataaaaacctcattctatgtttgtgccataatatcatcaaaaaacagtagagaacatatgacccggaccctctgcatctcagaaagacttattatcaactgaaggagacaacacgtagcctttgctggggacagtggtgtgacaagtctctggcccatcctaggtgctgccccgcacctgctgccttcttccaggcccaccccacttgggcagcctggtagcgctgggctggcggggtgtcctctggctggatcctttgcggccgctgcattccaacagggccggcactctcccgagggaggtgctgtctttgtttctccctgaggagacacaaagcgcagccaataggaacggacgagccccgtaactgcagcacctactgaagtgtgctccttgagcaacatttgtgtctgcacatttccctcaaagccacttcaagctgaaagccctgtatcagtcctgagtcctgaggctcagaactgccaaaggcaggtcatgccccagaagcccttggccacgggtccatttagggaagggtaagggtggctggtccatacttggcctggacaaggaacctggtctgccctgatggcgccaagcagcagcagcagcagggacttgccacttcatcctccaggtgtgttcacgctgaactgtacatctgagctgccttagatggtgacaggcaggaaacactccagtcaccaagtactggaattgggtttctgattttgattttggaagctctcacattgtttcctacctacccgagtattctgcaaacagtggtcaagccttgtagggagacaccctgaaactattgctatggaataaaagatgaaatgctcctgattattgtaaatacaaaattgcatgcaggattgtgtaaagacaatgccagcttggactgccagaacgagccaacagcacgtgatgtccttccacctgcagagagcctatgaatggacgtgcagtcagggaggtttcacatcaccaagattcctatcccagaaaagcagatattcatagctctgggaatggaatgcaacccttgtggagagcctataaacggatgcatggggggcgcctgtccatatggataagatacggctataaacgccctcatcttgccacagctcttctaggcctctttagggtgaaggcatactcccttctgagaatttctggtctaaccagttgtctagcttcacgtcctgtttccatggattgtttgtaaccagcttttgttgcaattgttactgctgattaatatcttgctaatcataggttatggaaagactgtgtttctgttctaagactctgttagaaattactgatgcacacactatattgtaaattcttatctttgtataccgtacttctacatacaaatgtactgtacttctacatacaaatgctatgttaaagaattacttcatccccatgtgaccatctcacctcataatcaaatgaccctaaatccctcactaacctacccccgccctcactaaacttaatagtaaatgctggtatatccagtgcattgttggcaccatgggaccagaaggcagtgaccccctggacccagctttcactatcttgtgtgtgtctattatttctcaacctgccaatccacctaggagcaaagagagagccccattgcattgcgggctgctggccagatccctcaataaagcctctcactctggagtttagctactggattccatgactgggttcctcccgtggtctgaatgcttgagactttccttctgaccaccagagaatcccagatgaagaccactggttcagatttccctcgatttgtaatttgcttactcctttttgtgaagatagaaagatctgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttccccctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaactggctctcagtcacccaagtggaaggtctggggcagtcccttgcgggagctctcctgccaccacttttggggtgagaccagatgacggttcagccaacagaacactcagcctcaatcctggttcttccctggcctcttaccaagtttagtcaaatcacctgcaattggaaactgcgctcttgaaaaaaagatgcaaccaggtgttttagggatccatgaggacatttccgtttcaccatttgtcatcttgaacaagtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggttatggtggtgtcacgcttggaactctgtcagcttggcacactcaactcaagaaagacggagtcagggttgcccagaaccaaggaggggtgcagccagaagcatgtggtgggtgaagtttggccacctcagtctaccagtgactcgtggaaaaggcacaaagcagagaatggccacctcgcatttcctttggtacaaactgccattattttagtctccactgactggtcgggggaaggaccccatctcccatgagcagatgagccccaccaccctgcagcagctcccacaatgggccagcatcctcctctgaggccacagtccctctgcgggccaggccagacagagtcagagcgtctgtagccgcggtgtttaggtgtccccgtgctctcagggtgactaatgtccagctccccacagcacacggcagggcagtctgcagacctgggcctgactcagagctggcttcccttcagcttggcaccatctgagcttcctctcttcccctcagtaatgactcggtcccttctggaaacaaggatgagagggaagcagaaaggaggaagtaagggttttgaaattttttttaaaatttttttggtttttagagactgagtcttgctctgtcacctgagctggagtgcagtgatgcaatcacagctcagtgcagccttgaactcatggcctcaagcaatcctcctgcctcagcctccagagtagtgggactacaagcatgtggccacacctgactaataatgcttacctttaaatctgacagggctgacaaacccttaacataactttgagccataatggatattaagaaaacaattctggaacccttcaggaatcatgtgctcttggggttagtgaggagccctgttcaggcctcctcactttatgaaggacgaggaggcccagaagagaacgacctgcagcatcttgcagtgggaaaaccagcttttttttttagctctgctcccttgggaggggctactgagtcagatgggttggacagtggggttgaaccaagtgttactgcaagttgggggggagggtggggtgactgatgtccccaggcctggtccctggagggtccttctatgcaccaaaaacagtcaatgaccaatgcatgttaaaacagacttcatgctataaccccaggctttgggaggctgaggcaggaggatcccttgaggccaagagttcgagaccagtctgggcaaaaacgtgagaccctatctctaaaaaaaaacaaacccaaaaaacaaacaaaagctgggtgtggtggcctgcacctgtagtcccagctactcaggaggctgaggtgggaggatcacttgagcccaggagtctgaggctgcagtgagccatgattgcaccactgcactccagcttgggtggcagagggaggctacctctaaaaaaaaaaattagattaacaaaacttaaaaatacaaaaataaaacaacaacaaaaccaaaaacagcctggctcattctcttcaaggtcagtgctcctgctactctgaaaccagctggtgaccactcggcattttgtgagcccctaacgaagcaaatctcaaaatgcagcagcctgtcagcctctcatgatctggggaatccctgaagctgcggagtgggccagaccaagctgggacgccctctgccatttacctttggtgtggcctatgtgagcccaactccccaccatttcccatctgggcagagctggttggggaatgaagatgtgtcccttctgctggtccccaagggtggcctttcttgtttcgtagtggcagcgcgaacttgcggcaacatgggctgaccaacatttgtgttaggaaggaaaacgggcagaggtgacgtgagagaactgagagggaaggaaaccaccactggccctgcttgagaagcagccgcagccagggcaggtggcatcagcagtggtgtctcactggcaggggcaggggcagcacagcaggccctttagtctgtggctcgcctaatactcctgtcggacagtgctgctccaacacattcatgacatgccttcagcaaacccaagtcaggggcatgagccacacatgcaattttttttttgagatggagtttcgcttttgttgtccaggctggagtgcaatggtgcaatctctgctcactgcaacctccacctcccgggctcaagcgattctcctacttcaccttcccaagtagctgggactacaggcatgtgccaccatgcccggctaattttgtatttttagtagagatggggtttcgccatgttagtaaggctagtctcgaacttcccatctcaggtgatccacccgcctcagcctcccaaagtgctgggattacaggaatgagccaccacacccagccacaattttaaattttctggtaaccactaaaataaaagaaaatgtggaattagaattcaaataatatattttaattaacccaaaatatccaacatattatcatttcaacatgtaatcagtacataagtttttcatgaaatgttgcaatcactttttttttcctttttatttaaatagagatgggaatctcaccatattgcctaggccagtctcaaactcctggactcaagtgatccacccaccttagcctcccaaagtgctgaaattacaggtatgagccactgtgcctggccctgcattcacttctgttcttttgtttgtagacactggatctcgctatgttgcccaggctggtctcgaactccttgcctcaagtgatcctcctgccctgcctcccagtgttgggattatagccgtgagctaccacgccctgcattcacttttgtgccagtcctttggcacctgctgtgcataacacacgcagtgcagtgaccatgccagccatatatagctcgtggttcccgtatcaggcagcacagctcatgtgagactcatggcttccacataccaaacgtcatcttacatgctctggacaactttaaaaaatgtgtagtttccctaaacttagagaccgcttgactgcatttagttttccctcaatgactccagaccctcaccacaagcattgcccgtctgttctggtgtcttctgtttcccctccctgtgggtatgagtgagcctggtggcggtggtccccgcaggctgtctggatggctgggggacaggcatccagagaggctggggcgcctgctgcagttcacagaggcaggcttgagtgggcctggcccgcggcctggagaactccacacccaagtcctgtgtgaaatctatggcctccatgccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagcccttgaagagcaaagaccctgaggggcccagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctggctaatttttttttttttttttttttttttttgtagaaatggggttttgccatgttggccaggctggtctctaattctggatctcaggccatccgctcgccttggtctcccaaattgctgggattacaggcatgagccactgcgtctggcccccgaatacatcttgactatgtcctgccacctccctcctcctgccctgggcccaccagcgcctggacagcactctgcctcgcccaccccctcccaccaccccagctcacaccttcggggctctgctgacccctcctgtcccgccctgtgtaacccttactgctctcctgctcagaagcctcctcctacctccatcattggcggtttttctcgccacctctcattggaacgagtgggaccatctcacttcactgccacaccctctgcactgacagacagccgggcccggcacccagaatccctgggtgaatggcaacatcccttagaatgacaaggactctgttcccagtttcttcctccccgtggaaacctgcccttcaattgctcatctcagcctgcagtccgtgcacccctaccccagcctgtccctcagcccctcctcaccctcccttgggcctgagctctggttggcagtgaggtgggcgctgtggggaggagcgtacaggaggtgcgaccagagccccttgggctctcacaggcccctggctctgggcccctggtttcatcacacctggtgacacctggaaggtggccccaactcaggagtgaggcgggcaaaggggctgagtgctggagtgtggccacgggaccagcacacggcatctgtgtggtgctgcccaggaggctcggagaaggcgggagcctctgtttcagcctccagacttcctgtcggggtaggggacagcttctaagaggcaaggtgtttgtcacgcctggggctgtgctctccagcacagcacaccacccctcagcctgctgtcctcccttggggtgggtggaattctttacagggcacaagtctcactcaccacagttcgcctctggggtgtgggatgttgatcctgtccccagatgccagcccaactgtgggccataccatgtctctaataaacagagccagaaatcgtgccctgtcgctaagccacagggcagcgttggcctacatggtcttgcccttgcagcttacaggttttcctgcctcctggggccgggcactttccatggaaacaagggagagcaccaaccaccagagataagccaataaccacgacctgagaaagaacaggcagcaagagaggcggagggaatggggtggggtaggggctggagagaaaggtgagtgtgtggcagccaggctgtggggcagaaccggagagcccgcaggccaagggcccaaggaaaagaggggttcgcagtggggttattgttcctggcagagaaaaaggaggcctctggaggtcagagagagacgcaaagagagcagacagagcgcggggtcagtgaggcctctgcgcaggtgcctggggcctctcagggcagggggactgggtgcccaggccctgcccccatgggggcagccggctctccgccccttctcaggatgcctgtgtgggtgtcctcatgcttccaggtggggagccagctctgggcctccttccagtggccggggaggttttgctgcatttcagagggagccgtcaggagcagaagcaacatgtggggaggaaagcagagacggaggctccaccatgacacactctcagcctcagcatctgctcagccccagtcaccatgctggagagaggaggcccttcaggccccgcaggcctctgtaccctgggagttctgcctctgactcttgtcctgcaatcctcagagggaagctggccagggctggtcaagcccctgcataggacctgggcccaagtggggtacaggcagggggtggcaggaagacttctgcctgccctgctccctcggcactttcctggaggctgtaatgccacaagacaggatcaaaactgtgctgttgtttttttttcgagaggagtctcactgtcacccaggctggagtgtaatggtgtgatcttagctcactgcaacctccgcctcctggattcaactgattctcttgcctcagcctccagagtagctgggattacaggcgtgtgccaccacacccagctaatttttgtatttttagtaaagatagggttttaccattttggccaggccagtctcaaactcttgacctgaaatgatacgcctgcctcagcctcccaaagtactgggattacaggtgtgagccactgctcctggcccaaaactgtcttttaaaaatatttttgggggtgctgggtgtggtggctcacacctgtaatcccagcactttgggaggccgaggtgagcagatcatgagatcaagatatcgagaccatcctggccaacatgatgaaaccccgtcgctgctaaaagtacaaaaaaattagctgggattggtggcgcatgcctgtagtcccagctacttgggaggctgaggcaggagaatcacttgaacttgggaggcggaggttgcagtgagccgagatagcaccactgcgctccagcctggcgacaaagcgagactccgtttcaaaaaaaaaaaaaatcttttttttttttttttttttttttttacagacagggtctcactctgtcatccagactggtctcaaactcatggcctcaaacgaccttccccccttggcctcccaaagtgcttggattggaggcatgagcccctgcgcctagcccaaagtcgtcttgattcctgactttgtggaatggaggcatgagtgaagaggtggggagaggctgaggaggaggagccctagcccacctggagcaccgtggggcacgcactctgcgtccacctggcctggacatgcctcctaaggataacagcgaagccagggagcagagcccacggatgggccctgcagctgctgggctgagaccgacagacaggcgtggtcactccgggccatgctggcgctgtgctgcccctgcccctctccaccccacctcccgaccactggggcagggacaatgggcccggctctgacttcgggcacgctcgtcgtgtgcagagacacggccgcagagtcctggggctcgctcgccatcctctgcccggcacacatcgacttgagcatctggaagacggccacgggggccacgttcaacttcacctggctctgaagctggccgctgtgggctgcatgagaatggtgtttctataaaacatgggaattgctggtcagacacagtgactcatgcccgcaatcctaccattttgggaggctgaggcgggaggatcgcttgagcctaggagtttgagaccagcctagggaacacagcaacacctcatctctacacacacacacacacacacacacacacacacacacaattagctgggcatgatggcatgcacttgtagtctcagctactaaggaggctgaggtgggaggatcacttcagcccagattgaggctgcagtgagccatgatcatgccattgcattgcagctacttgggaggctgaggcaggaagatcatgtgagcccaggagtttgaggttgcagtgagctgtgcctctaatcccagcactttgggaggctgaggtgggcggatcacaaggtcaggagttcgagaccagcctgaccaacatggtgaaaccccatctctactaaaagtatttaaaaaattaacctggtgtggtggcgggcgcctgtagtcccagttactcaagaggctgaggcaagagaatcgcttgaacccaggaggcggaggttgcagtgagccgagatcatgccattgcactctagcctgggcgacagagcaagactccgtctcaaaaaaaaaagattatgctgaaatttaccactattggtatgaatgatcagtattcaccaagcatatctgaacatgcaaatgtttaagaaataagcataataaggatatagcttgggttaataggattctcatagtttttttcccctatgaaacataagtaataattttagcatatttattatggattatactcatttaaaaaggactttaagaagttgtgctttgggaggcagaggcaggtggatcacaaggtcaggagttcgagactagcctggccaagatggtgaaaccccatttctacaaaaaatacaaaaattagccaggcgcagtggcgggcacctgtaatcctagctactctggaggctgaggcaggagaatcggttgaacccaggaggcggaggttgcagtgaactgagatcgtgccactgcactctagcctgggtgacagagcaagactccatctcaaaaaataaaaaaaagaagttgtggatgtgaataatacatttctctaataaaaatttaaattgtataatagtttaataaagtgtttacattcattgatttttttttttttaagacagagttccgctctgtcacccaggctggatttcaatggcatgcgatcttggcttactgcaacctctccctcctggtttcaagcagtcctcccacctcagactcccaactagctgggaccacaggcgcgtgggttaccatgctgggataatttttgtaatttttttgtagagatagggtttcaccattgttacccaggctctgtgctcaagcaaccagcctgcgtcagcctcccaaagtgctgggattacaggcatgagtcactgcacctggcctcagttatcctttctattacatcctatgatgttttcatagcctacaaggcatcaatttcttcttaataattgtcagtctggccaggcgcagtggctcatgcctgtgatcccagcactttgggaggccagggcaggcacatcacctaaggtcaggggtttgagaccagcctggccaacgtggcaaaaccccctctctgctaaaaatacaaaaattagccaggtgtggtggcgtgtgcctgtgattacatgctacttgggaggctgaggcaggagaatcacttgaacccaggagtcagagattgcagtgagctgagatcgtgccactgcactccagcctgggcaacagagtgagactctgtttcaaaataataataataataataatagtcaatctggttaaagaggtaacaatgatctattaatgctttgggaaaacaatttgggttgcctttgaaggccagggtttttagttcattcaaaaatatttatttaatttatagcatgtgccaagcattttttagcttcacagtatacagttgtgaaccaatcagataaggccctaaccatttttggcattctgtctagttggggtgggatgggggcttaattaagatagagatatagaaaaatgcgcatctatataacataagtatggagttgagaggaagcaactaacagtatgttagagatgttagaagtaatattttgcaggtttgtaacctctatttgacttttaagtttgggtagtgttaatagttgaagatagtgtaaaaaagccttaattttcactttccttgctggtaaaggtatgtttatttagactgttcatttatttatttctcactctgtcacccaggctggagtgcagtgctgcaatctcggctcactgcaagctccacctcctgggttcacgacattctcctgccttagcctcctgagtagctgggaccacaggctcccgccaccacgcccgggcaatttttttttgtttgtttgttttgtatttttagtagagagggggtttcaacgtgttagccaggatggtctccatctcctgacctcgtgatccacccgcctcagcctcccaaagtgctgggattacaggcttgagccaccgcgcctggcctagactacccatttaaagtagtgtttaacatggctgggtgtggtggctccctgtaatcccaggagactgaggtgggcagatcacttgaggtcaggagttcgagaccagcctggccaacatggtgaaactcagtctctgccaaaaatacaaaagttagctgggtgtggtggcaggcacctgtagtcccagctactcaggaggctgaggtaggagaatcacttgaactcaggaggcagaggttgcagtgagccgagatcgtgccactgcactctagcctgggcaacagagtgagactctgtctcaaataaataataaatacatacatacataaataaaaaaagtagcatttaacacaacaatcctgtgaaagcgattctattacatatccacaagctaattagctgcacactctttcctgtattttacaatttagcatgattttaggccccagtcttctcttcaaatcactggtgttttacatttggcaaagaataggaagttacttttgatttatggagtgattatattattactttaaaaatgtgttaatattttaggacagtttggagcctctatctttttttgagttagtatttcaattctcattacttattctaacagcttctaagtgaaaatagtatttaggcaattaaatcggcatatgttttcaggaattttctttcatttttaagttttgtcatcattgaggttaatgttttaacctggtgttcagttatgatatatataaacagtttgtgaagtgaaatagtcttaagtatgatgtgtgatgcacctacaaataaacgaaaatggcgtgcaccatgtctctttactgtgggaactgtactggaagatttatgaaagcatgtgacattgcacctaaagttgtgttattagtgactataagcagcagtgctaaatttttctattgtacttgatgaatgaatgcatttagtctagtcacagttactttggtttaaatgcatttgtctttagggtttgtattagttttcacattgctataaagaccccagactgggtaatttataaagaaaagcaatttaattgactcacagttccacaaggctggggaggccttaggaaacttacagtcatggtggaagaagaggcacatcttacatggtggcagacgagacagaatgaatgagctaagggagaagagccccttataaaatcatcagatcttgtgagcactcactcactattatgagaacagtatgggggaaacacccccataatctaatcacctcccaccaggtcccgctctcaacacatggggattatatggattacaactggagatgagatttgggtgaggacagagccaaaccatatcaggtttttattttttttagtattttattttattttattttttgagacagagtctcgctggagtacagtggtgcaatctcggctcactgcaagctccgcctcctgggttcacaccattctcctgcctcagcctcccaagtagctgggactacaggcacccgccaccaccactggctaattttttatatttttagtggagacggggtttcaccgtgttagccaggatggtcccgatctcctgaccttgtgatcggcccgccttggcctcccaaagtgctgggcccatatcagggttttaaaaaatgtgtttgtaatttgtactctcggcagggtattcttgggctgcaggggttgttgtcaatgtgtgatttgtgtttttattttatagaataatgtgatgtaccgatttttataagtgatagataattcgaataactgtatatttgacaacctattaaaatattttgcattggaacttctttcattaattgtaacatgctaacaaactgatagtggtttaaaaataactcattcattgaacaacaacaacaaaagaaaaaaggttaaaagtaaacatttttatgggaaatctcttatccaaaattctttcaagattttaccttatttagtgactagttctgtatttttgcatgaggaataaatatgtctctggaaggaaaaaaactattgctattaatagttatatgaaccttctagaacctaatctaataccagacaactgaggctaaagaaatgctagattgcagccccagtggccagacatgaatataagaaggaaaacaggctgggtgtagtggctcacgcctgtaatcccaacatatatatgtatatattgtggtggctcacgcctgtaatcccagaactttgggaggccgaggtgggcggatcacgaggtcaggagattgagaccatcctggctaacacggtgaaaccccgtctctactaaaaatacaaaaaaaattagcctggcgtggcagcgggcgcctgtagtcccagttactcaggaggctgaggcaggagaatggcgtgaacccgagaggtggagcttgcagtgagctgagatcgcgccactgccctccagcctgtgcaacagagcaagactccatctcaaaaaataaaaataaaaaataaaaaataagagtttagtcctcacatacctatgttttacatcaatccccaaatagttctttcccacaaagcatactggaccaatagtacagaaatgatttgtcaacttccaactttgtccagctagaaaaacactagaagccagttaaaatgtttgagcaagacaggacaaatgctctgtttcttccacaaacaaattgcaaataggaaaaaaggagggagaaagagcctatagattaaaagagatttatgaagtgtgctatccaaatgccaggtgcagactttgttttggcttctatgaaacaagtcaactttttttttttttttttttttgagacgaagtcttgctctgttgcccaggctggagtgcaatagtgtgacctcggctcactgcaacctctgcctcctgggctcaagcgattctcctccttcatcctcctgggcagctggaattataggcacccaccaccacgcctgggtaatttttgtatttttagtagagatggggttttaccacgttggccaggctggtctcgagctcccgacctcgtgatccacccgcctcggcctcccaaagtgctgggactacaggcatgagccactgcacccacccaaaacaagtcaactttttaaatgaagaaatttaaacaaacactgaatatttgatgattttgaaaaattactgttatttattttttcaatgtcatattactatggctatgtttttaaagaaagcccttatcttcttgaggtatactgaaatatttaaaaatgagataacagatgactggcatttccaaaataatcctttttgggaaaagggataagagtgaaatatgactgattatgagttggtaattgttggaacttggggttcatttttctagactctactttttaatgtatttggaactttattactaattgctatcactttcattaatactgattacagaaataaaaaatcaacaaatgaaaaattcaagacacccccaaaaaggaacaatgacattttcatacatgatatcatctactatttcaataatatctaaatagaggacagttgaggatgtgacatggaatactggggtagaatttttttttgaaacggagtcttgctctgttggccaggctggagtgcagtggtgtgatcttggcttactgcaagctccgcctcccgggctcaagaggctgagacaggcaaattacttggggccaggagttcaagaccagcctggccaacatggcaaaatctcgtctctactaaaaataaaaaaaataagtcaggcatggtggcacatacctgtagtcccagctacttcggaggctgaggcatgaagattgcttgagcctgggaggcagaggctgcagtaagccgagattgtgccactgcactccagcctgggtgacagagcgagactctgtcccgtgccccaaaaaaagtccattgtgattcttgtcgttgtcttactgttgaaatgtttacctaagtctttcgttcaaatgggatgctcgagaacacttcaggaaaaatgagaaacaattaaaattctccaggccaaacttctttatttatttatttggaaggagtttctctcctgttcccaaggctggagtgcaacggcgagatctcggctcactgcaacctccgcctcccaggttcaagcgattctcctacctcagcctcccgagtagctgggattacaggcacccgccaccacacccagccaattcttttttttttgagacggagtctcgctctgtcgccaagctggagtgcagtggtgtgatattggctcactgcaacctccgcctcccgggttccagcgattctcctgcctcagcctcctgagtagctgggattacaggcatacaccaccactcccagctaatttttgtatttttagtagtgacggggtttcaccatgttggccaggcatgcaccgccaggcctggctaattttgtacttttagtagagacggggtttctccatgttggtcaggctggtcgtgaactcccaatgtcaattgatcctcccccctccacctcctacaatgctgggattagaggtgtgagccaccgcacctagtctttttttttttttttttgtatttttaatagacacgggtttcgccatgttggccaggcttgtctcgaactcctgacctcaggtgatcagccgactcagcctcccaaagtgctgggattacaggcgtgagccatcgtgcctggctgccaaactttatttttaaaaacatttaaggctgggcatgttggcttacccctgtaatcccagcaccttgagaggccaaggcaggagaatagtttgagaccaggagttcgagaccagctggggtaacatagtgagaccccatcccaattaaaatatatatatattaaaaatattaaaataggctgggtgcggtggctcacacctataatctcagcactttgggaggccgaggtgggcggaacacctgaggtcaagcgtttgagatcagcctgtacaatatggcgaaacccagtgtctactaaaagtacaaaaattagctgggtgtggtggcatgagtctgtattcacagctactcgggaggctgaggcaggagaattgcttgaaccaggaggtggaggatgcagtgagctgagattacaccactgaactccagcctgggcaacagaatgagactctgtctcaaaaaaataaaaaattaaaaaataaaaattaaaatcatttaaagttcatttctttagaatatttctctcaaattataaatgtaatattttaagcttcagtaagttaaagttacaatacaataaaaaagaattactgtagcaggagaaaaataaaccatgagtgatgtagggggactattaaatggatattaattcataacagcatggatttttaaagttttttccttttttttttttttttttttgtgacaggctcttgctctgtcacccaggctggagtgcagtggcacgatcatggcttactgcagcctcaacctcctgggctcaagtgattctcccacctcaaccccttgagtaactgggaccacaggtgcgtgccaccatgtcaaaatcattttgtgtgtgtgtgtgttttttgtagagatggggttttgctatgttgcccaggctggtctcaaactcctgggctcagtgatcatctgcccttggcctcccaaagtgctgggattataggcgtgagccactgcgcctggccttttccttaatattaaatgaagtattatttatattacaaaccaattatttggagaaaccccgtctctacttaaaatacaaaattagctgagcgtggtggcacatgcctgtaatcccagctactagggaggctgaggcaggagaatcgcttgaccccgggaggcggaggttgcggtgagccgagatcgtgccattgcactccagcctgggcaacaagagcgaaactctgtctcaaagaaaacaaaaaacaaaaaaatacaaacaaaccaattattacgaaaatgctattggagaaagaaactgtaaaatctgatcaactgaggatctagcagtactaaaaaatatcaccattcaatcaggacaactagcaattctatattatatttagggaagttttctaaataatccattgcaaagtgaacaattgaggattaacagtctttgaagaaaaataattaaaaaggcaaagttccaaggtgaatgaagaactgatgcagaggaaacagatacatcagagagcataagaaaactttaaaaaattccagtgagtgtggtcagaaagagggaaaggggtgtttcctcacctcaccagctacacaatcataaagcagtgtagccttcatgagggaaatatttcaacccaagaattccatactcagtcaaatcaactaccagaacactgagggcacaatgagacattgcgagacattcaataacttgaaaacattaccatcctcaatccctatgggggaaaaaagaaatgttacacaatcaagcatgtatgtgtatacataatatgtatgtatgtataatacatctacatacatatagatattcctgctgcccacgaaaagactagcaaatcatcagaagagtaatccaaaaaacctgccgtgaacataaaacagtggcagctgactatgatctagaagcagcaaagaaagttaggaagaaaataggaggagggctaggcgcagtggctcacgcctgtagtagtcccagcactttgggaggccaaggtgggtggatcccctgaggtcaggagtttgagaccagcctggccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggctttgcagggaataaaatgtgcattaccataattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatatctcccactgaaaagcactgtatttgcatagttttgtaaatgaatactttgaaacttcattctctgaaatattctttttttgttttcttctttttttttttgagatggagtttcgctctgtcgcccaggctgggtgcagtggcgtgatcttggctcactgcaagctccgcctcctgggctcacgccattctcctgcctcagcctccagagtagctgggacttcaggtgcacgccaccacgcccagctaatttttttgtattttttagcagagatggggtttcactgtgttagccaggttggtctcgatcccctgacctcgtgatccacccgcctcagcctcccaatgtgctgggattacaggtgtgagccaccgtgcctggccctgtaacatattcttgaacacaagactggacgctttatagtttttcctaaaacttgatcataactctgatactacagtattccaagggtaatatacaaaagttaagaccacagactacagactactcctcatttgggaatatcgtttaaaaaaataataaaacatgaatacaaaaggctcaactgtgcaggtagagaataaaatgccatggctaagtgttttattctgggactgcttgaatgattccatagtattaggcatattaatctaaacaagaaaaatagtcaaagacgaaaatcacgatggtcttgaatagccatatttcaatattaatttctcattaaaagtcttagacttttagactaataagagtttttttaatgtttaaaaaaatctgactgggcgcggtggctcacgcctgtaatcccagtactttgggaggccaaggcgggtggatcacgtgaggtcgggagttcgagaccagcctgaccagcatggagaaaccccacctctactaaaaatacaaaatttagctgggcgtggtggcgcatgcctgtaatcccagttactcaggaggctgaggcaggagaatagcttgaacccaggagacgtgagttgtggtgagccgagatcgcgccattgcactccagcctgggcgacaagagtgaaactctatctcaaaaaaaaaaaaaaaaaaaactttcaaattaacattcaattttaatggaaaaagtctagaatataccttaaaataaaaaacaagtaaaatatttatagtaactacgaggaaggaggctttcacttttcatggcataccctcctgtaatgtttcaatttattagttttgagcatcctttttttttttttttgagacaaggtcttgctctgtcacccaggctggagtgcagtggcatgaacgtggctcaccgcagccttgacctcgtgggctgggaacacaggcacaccacagccatgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacaggtggattggtgctgtcatcaataataattgtgactaattagctcatcaggtcctaggatggctttggggcagcagttggtgcaacttctggtaacttctgtcatcaaactctggttatgtggatgtctctgagtcatatcaatgtagtagcctcttctgagtaggaatggtatttgtgtgtctctgggtctgaatccctcgtgaaactataagctccttgagggcaggtattatttctcattgctcttagcaagtcacctgttgtttggcatacccagctgtcctctggagactgtcctttactttctgcatccacatagctatagtaggagccaccatatttgcgcaacatggccctaccaatggctgctgttgactggactggagatagagcccatcttaagccaagccactgaaagcctcatggccccactcatggatgttgttgattggactgtgggtagggtccaacccaagctggaccaatggagctcttcctcaagattttggaattaagtttaagagaagggatcttactgacccagcttgagtatttagaggagctgttgacaccattatttttcctgtgaacagggaactagttaacgaagagaagtggtgctcatagaggagaaaaaagaatgagggacacagaaaaaatacatcttagatttcctggcatctctcagttcctgtttccaggcctgtagggaaaagaaagagagatcagactgttactgtgtctatgtagaaaaggaagacataagatactccattttgatctgtactaagaaaaattgttttgccttgagatactgttaatctgtaactttagccccaaccctgtgctcacacaaatatgtgctgtatggaatcaagctttaagggatctagggctgtgcaggatgtgcctggttaacaatatgtttgcaggcagtatgcttggtaaaagtcatcgccattctcgattaaccaggggcacaatgcactgtggaaagccacagggacctctgcccaagagagcctgggtattgtccaaggtttccccccactgagacagcctgagatatggcctcgtgggaagggaaagacctgaccgtcccctagccctacatccataaagggtctgtgctgaggaggattagtaaaagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgccgcattccccttgcggagatagtgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagcttacagataaggaaactgaggctcagatatgttgaataacttgtctagagaagaaatggggattatatttaattattttaacaaattccatgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaaaaggtgtgctatcagcatgaggctgttgaaagataataaggtagccagtgagcaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcatgatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaaaggctgcagagccacttttggttgacagtcatggatgatgagtgccagcagtccagctccttctcctctgagctgtttctccactgctctgagatcaacctcttaacaaacttggtccccaggtaaaagccctcctgagacatttggttaagaagaggagtttcccatttctccccttctcctttcagccaccaggcattgaagggagcagtgctgaggccatttaaatgggcttctccatagaatgggcccttctgttggaaactgggttatgcacaaaccattcacaatggctttttacaccccagaagcactaagatccccctaatcttcagtcaaaacagagcatgaagggtggggtattcatcccaaaggcactgggcatctgaaagttagggaggggtgggaccacccacattcagggctttgattttccagccagaatgacaagaccacaagacccccaggaggactccatccttctcattctttatgtggtggacccttaaaaagtgcaaggtgggaggctgaggcaggcggctcatgagatcagaagatcgagaccatcctggccaacatggtgaaaccccatctctactaaaaacacaaaaattagccgggtgtggtggcacacgcctgtaatcccagctacttgggaggctgaggcagtagaatggcatgaacttgggaggcagagattccagtgagctgagatcgtgccattgcactccagcccaagactcagtctcaaaataaataaataaataaataaataaataaataaataaaataaataataaattaaaagtgcaaggcttttttttttttttttttttttgtgacagagtttcgctcttgttgcccaggctggagtgcaatggtatgatctcggctcactgcaacgactgcctccctggttcaagcgattctcctgcctcagtctcctgagcagctgagattacaggcgttcgccaccacgtctggctaattttgtgtttttagtagagacgaggtttcaccatgtcggccaggctggtcttgaactcctgaccactggtgatccgcccacctcggcttcccaaagtgttgggattacggggtgagccaccgtgctggccacaaggcatcctaacaagagttttgctaccattatctcccgttacagttgaggaaactgaggcatgcagaggttaaatgaagcacccatcagagccaagcagttagatggcaaagttgtattagtctgatttaagaaaagtttaatacaggtaccatttacagaggtgcagacagtgtattgatttttttttcttttctttttttttttttttttttgagacggagtctcaccctgtcgcccaggctggagtgctgtggctcgatctcggctcactgcaatctccagctcccaggttcaagcgatcctcctgcctcagcctcctgagtagctgggattacaggtgcctgccaccacacctggctgatttagtaaagatggggtttcaccatgttggccaggctggtctcgaactcctggcctcaggtgatccgcctgcctcggcctcccaaagtgctgggattataggcatgagccactgcgcccgacagtatattggttttctatttctccataataaataactacaaacttagtgactttaaacaacacccctccattaggtcatagttctgtaagttaacaggccaggtatggcctgattgtctcctcagtgtgtcacaagtttaaagtcaaggtgttgctgaggctgtgatctcatctgaggctcagggttctctttcagactttttccagttgttggcagaattcagttagttgtggttgtaggactgaagcccccacttccttgctggttgttgtccaggaaccacttttatcttttagagaccacactcaaagtccacaggcaattcacagcatggatgtttgctccttcaaggccagcaggtggctgtctctcactcttcaactctctttgacttctaagggtcacctgattaggccaggcccacccaggataatcttccttttgattaactcaaagtcaacctaataacagtgtgaaatgccatcatatttgcaagtccagcccatcctcaaggggagggcattatgcagggggtgttcaccaggggagcaacaatcttggcagccagtttagtattctgcaatgcagagacaggaagcaggaaaccaccaggaatactgcagctccctgggaagagcagtggcgggacttgattacaagccctagtcatgaatagatgaggagctgagagacacagaaggctgtggggagagggccaccaggaagatgctgggtcctttggttgaaggacacagctagtccatagttacttggcaaggagggagctagaaaaataaatagcctgacctcagtttcctttcttttttctttctttccctccttctttctttttttctttttttttttttgagacagagttttgctcttgttgcccaggctggagtgcaacggcgtgatcttggctcactgcaacctccacctcctggtaaaagggattctcctgcctcagcctcccaagttgctgggattacaggtgcccaccgccatgcctggctaatgttttgtatttttggtagagacggttttgccatgttggccaagcttatcttgaactcctgacctcaggtaatctacccgcctcggcctcccaaagtgctgggattacaggcatgagccactgcgcccggccttctcactttcttttttgagatggagtctcactctgccacccaggcttgagtgcaatggcgaggtctcggctcactgtaacctccacctgggttcaagcgattctcctgcctcagcatcctgagtagctgggactacaggtgtgtgccaccacacccagctaatttttgtagttttagtagagacaggggtttcactatgttggccaagctgctctcgaactcctgacctcatgatccgtatgcctcagcctctcaaagagatggcaaagatcccaaagattacaggtgtgagccaccgttcccggccactttctcactttcatcttctgttgttgctctcctttggctgatcttaacatgaagctgagtaagggagccagcttattgatgcagtcagtagaagccagcttcccagggagatccaggttgggggaatatggagtgtggatcaggagaggtaaggagatgatatttggcaaaagtacttcttagagtcacacatcttgtaatgatagacctcagattcaaattcaagtctgtttaaagtcaaattataccatctatgcatccttccatgcatccatccatgcatccatccatctatccatccatccattcttccatttcctgagtgcctactgtgtggcaggcattctgctaacctaacaacccagtgagagacatacttatattcctattttataaaggcccagagaggttaagtaaataatccagagtcacacagccagggagtggcaaagctagaattcttatttaattccaaacttgatttctaccctctccaccaccaaccacccatatatatccactgaccaacctattcattcatcagacttttactgcatgtctcaagtaagctatgcactgtgtttagagctgaatgagacaccattcttatgtctccatgatattcacagtctggtaggagaaacagacctgtatacaggttattgtgcagtggtcggggacaggaactttgagagaggaacgtatggtgcccacttgtgggcatataggagtgagaggtctgctcagctggggaaagacagcatccttttgaggtgggttttgaaggatgcataagattttaaggggacagtgcatcttggaagggcatcatatctttgtagtccagctgcctctcctttgctcgagcttccttccttccttcaggggttaatttggaaggactgagttttgctgttattgagcaaacagagtcctctaaagtgcatagcccaggggctggaatggagctcacgatgtatgtgtgggggagaaaaactactttgatttgaattcctgtctggctatttttgagatgttatatatgaccttatgagggcccttccctatgtggtcatgtctataagagatttcgtatctttacccactggtgtcaggttggctgggtgactttcagccaatgggatatgagtggaggtggtatgtgctaattctgggcagacccattaagggcccttctgtggtcaccctttggtctccctttttgtgatactatggatagtctttatttattattctccaagggttgtgcctcaccttccctttttactgctgccccaagaccatcaggtttccacaagggggttgcttctttagccttaatcctggaatgaagtgatgagggtcagagccagagctgagctgcaagtgtgtgtcacattccagaggaaggaatggttgttactctaagacatggacttttgaggtcatctgttatcatagcatagtgtagcctaagctgaccacagcaaggcatctcacctttcgacatgttagtttgctcatccatagaagtggattaatagttgtagtcgcatggcaaaaacccatccctacaaaaaaaaaaaaaaattagccaggcatggtggtgcacgactgtagttccagctactcagggggctgaggcgggaggatcatctgggcctagggaagttgaggctgcagtgagctgtgatcacaccactgtactccagcctgggtgacagagtgagatcctgtttcaagaaaaaaacatatctgtagtcatgttattgggttttgtgaaaattaggtgaaattgctcagtaaaagcacagtttctagcccaatgtgtgtctgcactttgcagatgttcaagactcttcttccagtccctttctctgtcatacttatttctccccagggcctttgcatgtccatgctcttcctttgcctgaggctttttctcatttccttctttactcaagatcccatatgcagacctagctcccccagggggccagataaggatgggcttagagccccagaaaagtcaggacaggaaagggatgagaaaggttgcacttcagcaaccagaatcaggaaatctagaagagagttcctttaacctcaacatgtgcatatattttgtgctttatggttttgcattcttttaattttgatttacatcgggtatcttggctgggcgtggtgactcatgcctgtaatcccagcactttgggaggccaaggcaggtgaatcacttgaggtcaagaatttgagctcagcctggccaacatggtgaaaccccatctctactaaaaatacaaaacttagccaggcgtagtggtgggcgcctgtaatcccagctacttgggaggctgaggcaccagaatcacttgaacctgggagggcggaggttgcggtgctgagatcatgccactacactccagactgggcgacagagtgagactctgtctcaaaaaaaaaaaaaaaaaagtgacataattaaaagagccatcatctatggcctttaagtgtcatgtgtgtgctcatctttccttgctttactactcaaagattatcttttccatgtgacctgctctttcctgcctctgtcaccaccaaacatcaaagccttaagttttgtttggctgtttgttatctcttgagaattgagcaccagagctattgggtgggcttgatgttgacctacaatgcaggatgtctgtgggcatgactctctcctaggcactcacagacacttgaagctggggactgaggtcctctagtgtgtgtctgtgggggtgaaggagtgcaccctcatcctcctgcactttcgggtcttgtagcagcaactccctgtttctgtcctttctacttactgctggtttcatcacactcccagggttaatttaaagaaccagcctcggtgtgatgcacctacaacaaacagagccacttctgtggggagctctggagctgggatggcccctcagagtctagaggtggtgagagcgctggagcttcatcaccgtgctaactgtgtccctggaagagtgagggagcttgagtgattccttacccaagggccgtcataaaaggtctcagctgatgcctactgccgatcacattcagctatttgggaagagatgttcagtccttaagaggacattattagtggacatcactctttccacaaaagccccagtcttgtgttacttagtcccactagcttctttaaagaaaccccaagagcatttcctccaggaatctgtttgatctcttttcctgggggagatttccaggtgattctcattggaatgaatcctaggtcctgttgctgctgctggtctcacactgtgactgatgctaagtccttctcttccaccaccattctggattttccttgctatagcctaagtgtttatgtctccccaaattgtcagcgttggagcaccaagaagacaggcagcactgacagtagcagaagagtaggaggtggctgtggcaccccacgccgagcaggagcgggaggagttcctgggcgatggggccgcagcctgggccgatgctgaccatgggatgagatcattcttcactctgcaccgtgaccatcagggggcgccccaaccaccttttctgccccacatcgtgctcttgcagtgttctccccgcaggtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggtgagtacagaagctttagttttctggtatgttctgttcattcctctcctgttctccctggttttcctctttctcttgtagtgttttagtatttattttacagtggtattcattctctgaaggcttttgagggtgtcaagtgtagcagactgtggtatttttaggggtttaagactttttctgggtgggggggaggggggagggatagcattaggagatatacctgatgctaaatgacgagttgatgggtgcagcacaccaacatggcacatgtatacatatgtaacaaacctgcatgttgtgcacatgtaccctaaaactttaaagtataataataataaaaaaatcttggtttttattaaaaataaataaataaataaatacatttctagttctgaaaaaaaaaaaaaaaaccaaaccaacaacagaaaaagactttttctgagggaacctcccctgtgtagagggagagagagggaagccccgctcaggttggagtcagggccaggcccagttctggctggctgcctcgtgtccaagcctcagagggaggatttgcattgggccttgctgcatttttaaatcttcgttcctgccatcaggacccaggggtcactcttcttcacttttgggcagcgcgtgtcctctcgtgtccctcccaccgtggccgcctgaccaggggcgagggactcctcggtgtgggttttttgtcctctttgcagaaatgtctgttctgggcctctgcccagtttggggtggattattttttgttgttgttttaaattgctatttagtactgttaatgtgttgtatattttcggtaagaaccccttagcagttatatgattcctcaaaactttcgtccaaacttcgggctcattttttccgttgtggcacagaagcttttcagtttcttgtagcctcacatggttgttcttgctttccttgcttgtgattttggtccccaatttaaaaaaatcattcacaaaccattccattctccatgaggtttttaccccttatgtattcctctttttctttttgaaactctttccaactgatgagcatggattcaagttgtcctgaaagtaagctccccctatcttttcttacaggaatttaataatgttttgtggtttcaggttttgtgttgaaatctttaatccattttgagttgatttttgtgtatcgtgtaacagaagggtcctatttcttttcttttcttttttgcatatggatatcagtttcctcaaaatgatttcatgaagaaactctcctgtccccattgtgtctttctgatctctggtgccgatttcatttgctctggagttatacccagtagtgggattgctagatcttacagtatttgcattttctgtcattttctttgagacggggtttcttctgtcacccaggctggagtgcagtggtgcaatcacagctcactgtggcctctacctccacagcccaagcagccctcccacctcagtctatggtagctgagaccacaggcacacaccaccatgcctggctaagtttttaaattttttgtagagacagggttttgccatgttgcccaggctggtctcgaactcctgagctcaagtaatctgcccacattgaccttctggtaattgtattttcagttttttgaaaatggcaacttccaactttttaccatagaatatgtactaatttatcttcccatcaacagggtataagagttcccttttctccaaatccataccagcattctttttaaaattttgtggccaggaacagtggctcatgcctgtaatcccagcactttgggaggatgaggcatggtggtgtgcacctgtagtcccagatacttgagaggctgaagtgggatgatcacctgagctagggaggtcaaagctgcagtgagctgggatcacgacactgcacttcagcctgggtgacaaagtctgagtccctgtctcaaaaaattaaaaaaaaactttttagtaacatttatttcaataaaagtgaaacggcatctgaatgtggttttgaggtacattttttttctgatgagagacgttgaggaccgtttctcttacatgttggtcaattttgtgtcatctttgcagagatgtctactcaagttctttgtattggtttggatatgtattttgctacattgtattttttttctgtgtatatgtttgataacaaccagtgattgagttatcgcttacatgattccctttctttttttttttttgagacagagtctcattctctcacccaggctggagagcacagtagcacatcacatgaccatatatattggctacctacagctttgcaatgtaatttgctatcaggaattgtgagtctcccaacttagtttgtatttctcaggattccttagaggttcagggccattagtggttctatgtgaatattagcattttatattcatatttcttaaatttttgccatgtataataacatacacaattagaagttatgctgggacatgtttttttctttggggacattttgatacatgtatactttgagtaatgatcaaatcagggtacttatcataactattccctcattgaggtattatttctttgttgtgagtacattcaaattgctcccttctagttttttgaaaaatacaatattttgttaaccagagttacccagctgtggcatagaaaaccaaaatgtgtttcgccaaactcactgtaactttgtttccataaccgatccctcccatccccctcctatccccctccttcccctctcctcaggaaaccgctactgtaccttctgcttgaaggtaaagttttttggattccatataagtgagatcacatagtgtttgcctttctctacctagtcgatttcatttaatgtaatgtcttccaggttcgtctgtgtttttgcaaatgacatgttgtcatgaatttttatgcatgaggcatatttcatcatgtctgtatgctgaagtcccttcatcctttcattggttggtggacaggtaggttgatttcataccttggttactcattgttagtgagtagtaggtcactaaacctcagaaggcagctgttgcttcaacagaccgatctcattttctttaagctcacaaccacggttagaattactagatgaaacagttcttgcatttttaatttctgagggtgctccaagtggttttctcagtgcgtttcatcattgaaatttctcccaatagtgtataagaggatctctatatctaacagcaccctgaacttttatttttaaattatttctgttttggtattattcattttacttagcgttagatagtatctgagtgtggtctttatttacagttttgtgatgaccagtgatgttgagaaacaccttttttaccttttaatcaatatcataccttcttttcagaaatgtctgttattcaggtttttttgcccagtttttttgggggtattgggtcttgtatgttttgtccctctgtagcgttagtttctgctgttgtcagataacactccctttcagatatatgattcctcataatttcctttttttgatgtgtaaaaagataaacctattgtggcaacagccaagaacggtaataatcaaatgcaggaattaggtgccatttatatttccccactcagagtataagacttcctgcctcacagaagtaaatgagatttttctgtgcatatagtaaaattttacttttcatattttaatttttcgtgtcctaaaaagttaacacaatttaattaaaaattaaagccactaaaacatttatgtaacaatttctttttaaattttactttaagtcctgggatacatgtgcagaatgtgcaggtttgttacataggtatacatgtgccatggtggtttgctgcatctatcaacccgtcatctaggtttcaagcctggtatgcattaggtatgtgccctaatgctctccctccccttgcccccaaccccctgacatgccatggtgtgtgatgttcccctctctgtgtccatgtgttctcattgtaacaatttctttaattaccacataaggtactatgttatctgacaaatctatgttttacagagaaattgtagaaaagtcattcacaagtttcttcttgatttcaaactgtaacacaatgttgtaagtaatgcaactagacagaattcggctggatattgaaattcaacataataaaaaatatatatgctggtttatccatactactcacactgttagtatgaatgctctatcctaaagacagaaacaagtgtcttagtgaatctatatcattacaaactagattagcttttctccttttgaattttagaaaaatacaaaaattcaattgcctaattattgtacacagtgtttcaatatatgcatgactaaagcaattataggatttttttttttttttttttttgagacagaatcttgctctgtcacccaggcctgagtgcaggggcgcgatcttgactcactgcaacctccacctcctggctttaagcgattctcctgcctcagcctcccgagtagctgggactacaggcacacacaccacacccagcttattttggtatttttagtagagacagggtttcaccatgttgcccaggctggtctcgaactcctgacctcagatgatccacccacctcggcctcccaaagtgctgggattacaggtgtgagccaccatgcctggccacaattatagtttttatataggagtaagaaaggtcttaaatggaaagattaaaaaggattgcaaatcacatggcagcagaagggagctataattataacatgtcagcaagaaaaccaaaaatcacctttcaaatctagaggattatggaaagatatctgaaaaaattgtacacttctgataaaggcagtttattttacacaaaatgcttaccaataatgtgcatgaggaaaaagtgaactcagaagttgacaagggaattcaaagagggaagaagaatttttgtaccaaatgctgcttgaataacaaaatataaatatttgcatcccattctcactccatacggaaaacaaatgggtacttctttctaaccttggaacaggtagaagtttcttgtaaggacacagaaagctctaaccctacataaagacatttataggttaaacttcagtgaaaattaaaggttatcaaaagacactataaacatgaatatgcaagccacagacttggggaaatatatgtaatacatgcatttgtcaaataattcatctcatataaagaacttttacaagttaacaatacagaggcaaacaggccaattaaaaagtagaaaaacttgaacagacagtttgcaaagcaagacatacaaatagccagtgggtatattaaacaatggtcaacatcactaacagtcaggaagatgcaagttaaaatctcaagatacaatttcatttgatttcacattttagccactgtaatggcaaaatcaaaacgactgataatactaaatgttgatgaaaataagaattaaccaacactctcataaaactggtggaattgtaaaacaactactttggaaatggtgtagcaatttcttgtaatattaaatatacacttaacctatgactcagcacttttactccaagctgttgatccaagaaaaataaaaatgtacattttagtacattttttagtacatttagtacattttttctagtacaagtctatgtgtgtatgtatgtgtatgtatgtgtatgtatacacacgtacacctacgtagacttgtactagaatctaacatagcagtcttatttacgttaacccaaacttggaaatgagccaatgtcctttgacagtgaataaataaataaaccatggtgtatcacacaacagtatatattcagtgattaaaagagaactatagaatcgcacaacagcatgggtgaatctcaaaacagaaaaatgtatttagagaaggaagccagacattgaaaagtgtggatgtgtgattccatttatttgaaatgcagccataagaaaaatttatctttggtgacagagctcagaaggtagttgtttttgacccatgaaggtactgactggaaagagatgtgagaggattttctggaaatgttctatattttgactgggatagtaacatgagggtctataactgtcaaagctcacagaagtgaacatttaaaacttctgcattttacaaagtataaattgttccataatttaaaacaataaacagtctcatatcattcattccttcaacaagtaattatacaggccttgccttttagtagttctgcagccttgtgaagatttgaagatttcttaacctctctgagatcatctagctcaagccaaatgggataatcataaaaaccacctcaccagggtattgaaaaaattagttataaaatgtttaggtcagtgtgaggcacatactagatcctcagtaaacattaactgattctatatttaccattcagcacccagacttgagaaaggggcaaggcaaagaggaagctc
